(12) United States Patent
Young et al.

(10) Patent No.: US 12,269,869 B2
(45) Date of Patent: *Apr. 8, 2025

(54) CHIMERIC ANTIGEN RECEPTOR EFFECTOR CELL SWITCHES WITH HUMANIZED TARGETING MOIETIES AND/OR OPTIMIZED CHIMERIC ANTIGEN RECEPTOR INTERACTING DOMAINS AND USES THEREOF

(71) Applicant: The Scripps Research Institute, La Jolla, CA (US)

(72) Inventors: Travis S. Young, La Jolla, CA (US); Leonard Presta, La Jolla, CA (US); David Rodgers, La Jolla, CA (US); Eric Hampton, La Jolla, CA (US); Timothy Wright, La Jolla, CA (US); Peter G. Schultz, La Jolla, CA (US); Eduardo Laborda, La Jolla, CA (US); Elvira Khialeeva, La Jolla, CA (US); Sophie Viaud, La Jolla, CA (US)

(73) Assignee: The Scripps Research Institute, La Jolla, CA (US)

( * ) Notice: Subject to any disclaimer, the term of this patent is extended or adjusted under 35 U.S.C. 154(b) by 690 days.

This patent is subject to a terminal disclaimer.

(21) Appl. No.: 17/461,365

(22) Filed: Aug. 30, 2021

(65) Prior Publication Data
US 2022/0073597 A1 Mar. 10, 2022

Related U.S. Application Data

(63) Continuation of application No. 16/343,353, filed as application No. PCT/US2017/057460 on Oct. 19, 2017, now Pat. No. 11,174,306.

(60) Provisional application No. 62/410,315, filed on Oct. 19, 2016.

(51) Int. Cl.
| | |
|---|---|
| *C07K 16/18* | (2006.01) |
| *A61P 35/00* | (2006.01) |
| *C07K 14/705* | (2006.01) |
| *C07K 14/725* | (2006.01) |
| *C07K 16/28* | (2006.01) |
| *A61K 39/00* | (2006.01) |

(52) U.S. Cl.
CPC ............. *C07K 16/18* (2013.01); *A61P 35/00* (2018.01); *C07K 14/7051* (2013.01); *C07K 14/70517* (2013.01); *C07K 14/70521* (2013.01); *C07K 14/70578* (2013.01); *C07K 16/2803* (2013.01); *A61K 2039/507* (2013.01); *C07K 2317/24* (2013.01); *C07K 2317/34* (2013.01); *C07K 2317/55* (2013.01); *C07K 2317/565* (2013.01); *C07K 2317/622* (2013.01); *C07K 2317/73* (2013.01); *C07K 2317/76* (2013.01); *C07K 2317/92* (2013.01); *C07K 2319/02* (2013.01); *C07K 2319/03* (2013.01); *C07K 2319/30* (2013.01); *C07K 2319/33* (2013.01)

(58) Field of Classification Search
CPC ...................... C07K 2317/24; C07K 2317/622
USPC ....................................................... 424/134.1
See application file for complete search history.

(56) References Cited

U.S. PATENT DOCUMENTS

| | | | |
|---|---|---|---|
| 11,091,546 B2 * | 8/2021 | Young .............. | C07K 16/2803 |
| 11,174,306 B2 * | 11/2021 | Young .................... | A61P 35/02 |
| 2013/0287748 A1 | 10/2013 | June et al. | |
| 2015/0079088 A1 * | 3/2015 | Lowman ............ | C07K 16/2803 |
| | | | 435/69.6 |
| 2015/0307564 A1 | 10/2015 | Young et al. | |
| 2019/0169289 A1 | 6/2019 | Young et al. | |
| 2021/0116455 A1 * | 4/2021 | Brinkmann ........ | C07K 16/2887 |
| 2021/0238291 A1 * | 8/2021 | Lowman ............ | C07K 16/2863 |
| 2022/0041736 A1 * | 2/2022 | Kufer ................. | C07K 16/2803 |

FOREIGN PATENT DOCUMENTS

| | | |
|---|---|---|
| WO | 2015057834 A1 | 4/2015 |
| WO | 2015057852 A1 | 4/2016 |
| WO | 2016054520 A2 | 4/2016 |
| WO | 2016168773 A2 | 10/2016 |

OTHER PUBLICATIONS

Zahnd et al (J Biol Chem. Apr. 30, 2004; 279(18):18870-7. doi: 10.1074/jbc.M309169200. Epub Jan. 30, 2004).*
Rodgers et al (Proc Natl Acad Sci U S A. Jan. 26, 2016;113(4):E459-68. doi: 10.1073/pnas.1524155113. Epub Jan. 12, 2016.).*
Almagro & Franssen, Frontiers in Bioscience, 13:1619-33 (2008).*
Marchalonis et al., Dev & Comp Immunol. 30:223-247 (2006).*
Lippow et al., Nature Biotechnology, 25(10):1171-1176 (2007).*

(Continued)

*Primary Examiner* — Lynn A Bristol
(74) *Attorney, Agent, or Firm* — Hugh Wang; Thomas Fitting; Jennifer Kisko

(57) ABSTRACT

The present disclosure provides compositions, methods, kits, and platforms for selectively activating and deactivating chimeric receptor effector cells using humanized chimeric receptor effector cell switches that comprise a humanized targeting moiety that binds CD19 on a target cell and a chimeric receptor interacting domain that binds to a chimeric receptor effector cell and/or chimeric receptor effector cell switches comprising optimized chimeric receptor interacting domains. Also disclosed are methods of treating disease and conditions with such chimeric receptor effector cells and chimeric receptor effector cell switches.

24 Claims, 31 Drawing Sheets
Specification includes a Sequence Listing.

(56) References Cited

OTHER PUBLICATIONS

Hasegawa et al., MABS, vol. 9, No. 5, pp. 854-873 (2017).*
Altshuler et al., Biochemistry (Moscow), 75(13):1584-1605 (2010).*
Vajda et al., Current Opinion in Structural Biology, 67 pp. 226-231 (2021).*
Marks et al., J. Biol. Chem. 295(29) 9823-9837 (2020).*
Akbar et al., Cell Reports 34, 108856, Mar. 16, 2021.*
Lo et al., BMC Genomics vol. 22, Article No. 116 (2021).*
Zahnd, C., et al., The Journal of Biological Chemistry 279(18), 18870-18877; Epub Jan. 30, 2004; Apr. 30, 2004).*
Rodgers et al., "Switch-mediated activation and retargeting of CAR-T cells for B-cell malignancies", PNAS, vol. 113, No. 4, Jan. 26, 2016 pp. E459-E468.
Cao et al., "Design of Switchable Chimeric Antigen Receptor T Cells Targeting Breast Cancer", Angewandte Chemie International Edition, May 4, 2016, vol. 55, No. 26, pp. 7520-7524.

* cited by examiner

FIG. 1A
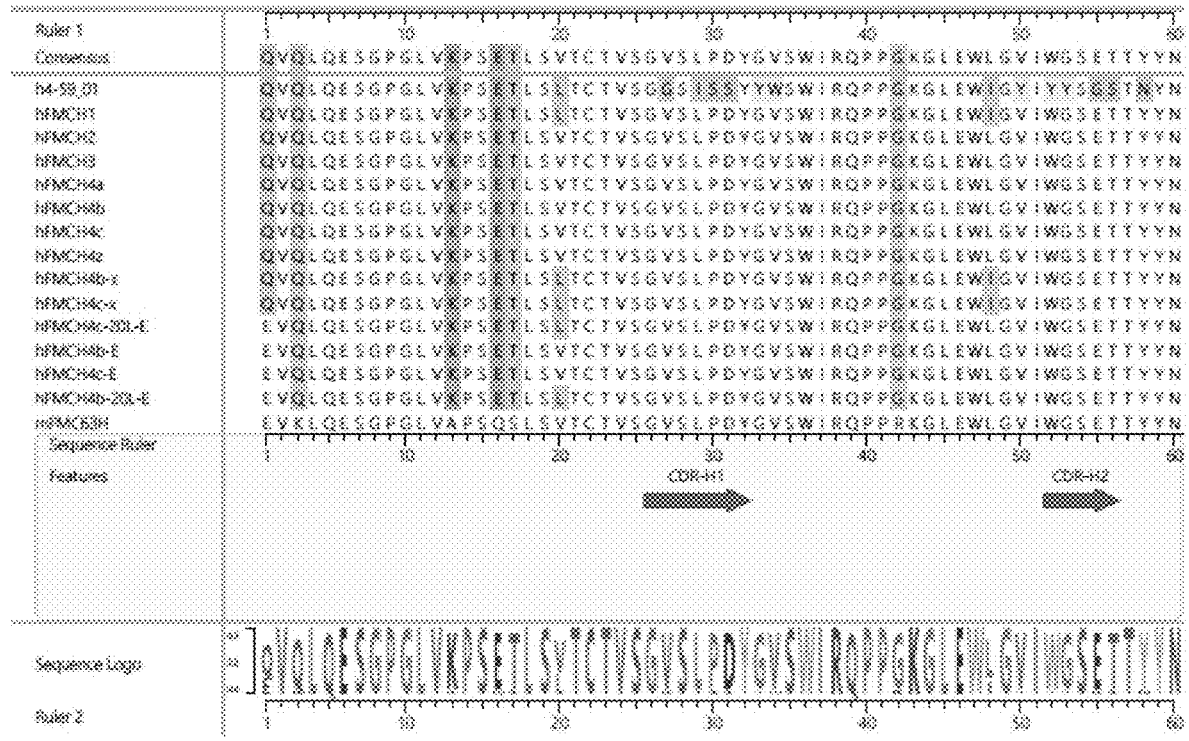
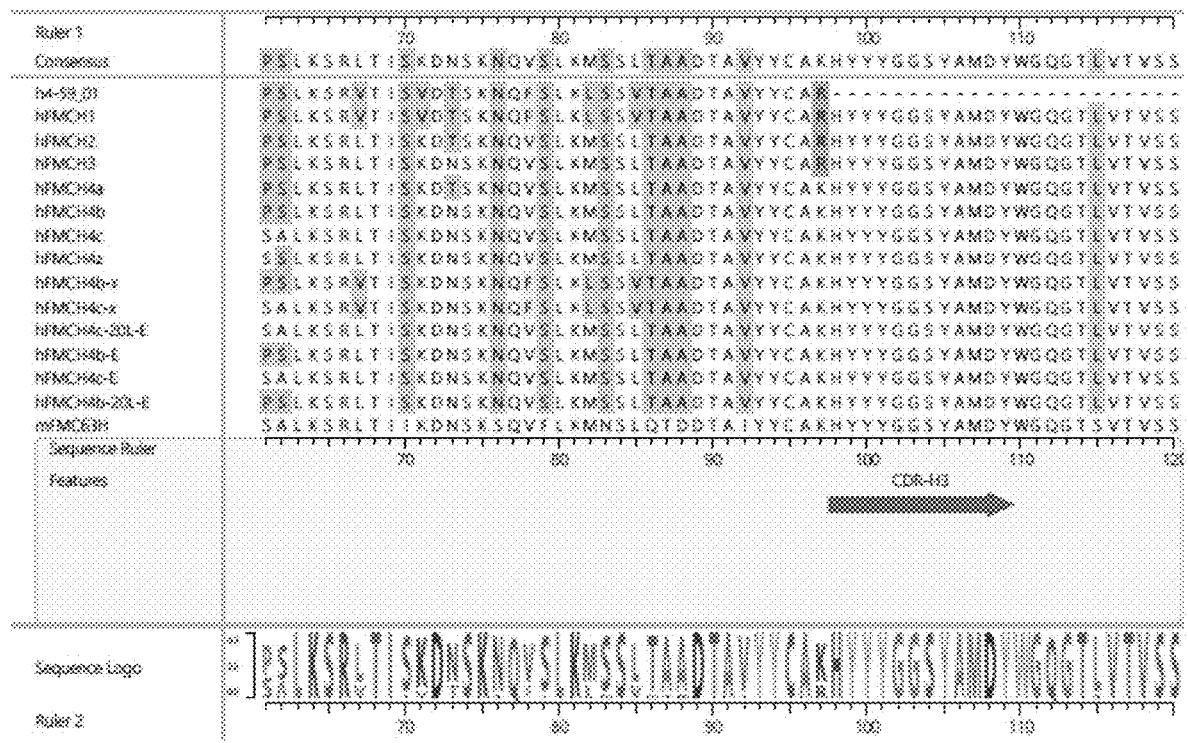

FIG. 17A
FIG. 17B
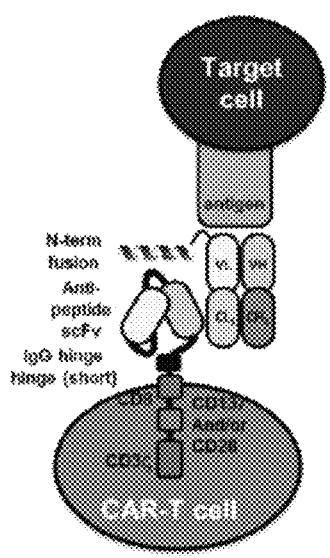
+
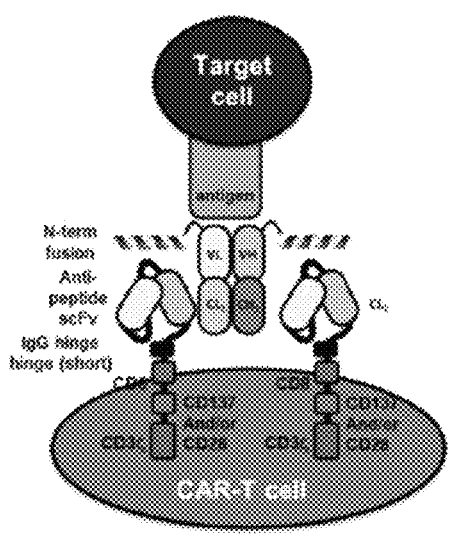
FIG. 17C
FIG. 17D
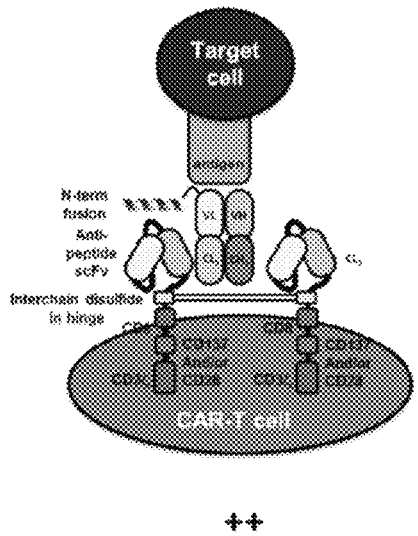
++
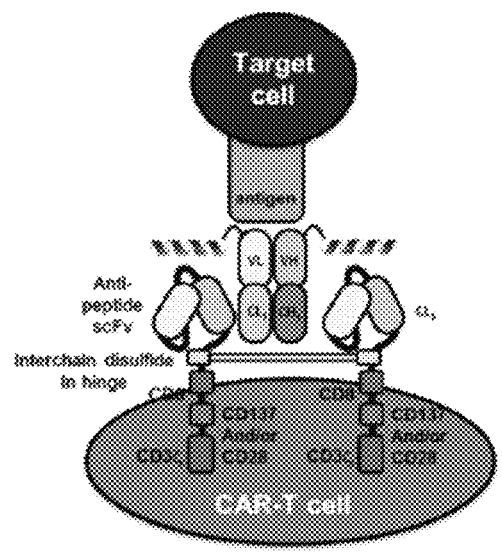
++ or +++

| | 1 | 2 | 3 | 4 | 5 | 6 | 7 | 8 | 9 | 10 | 11 | 12 | 13 | 14 | 15 | 16 | 17 | 18 |
|---|---|---|---|---|---|---|---|---|---|---|---|---|---|---|---|---|---|---|
| | L | L | P | K | N | Y | H | L | E | N | E | V | A | R | L | K | K | L |
| Modifications | L | L | P | | | | | | | | | | | | | | | |
| Original peptide | | | | | N | Y | H | L | E | N | E | V | A | R | L | K | K | L |

FIG. 22A
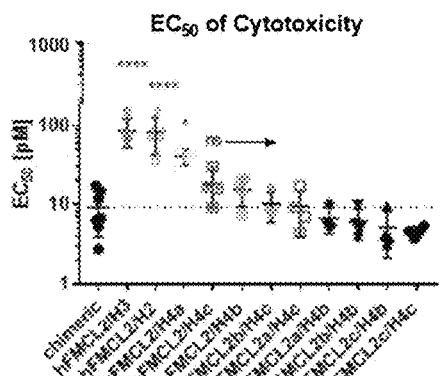
FIG. 22B
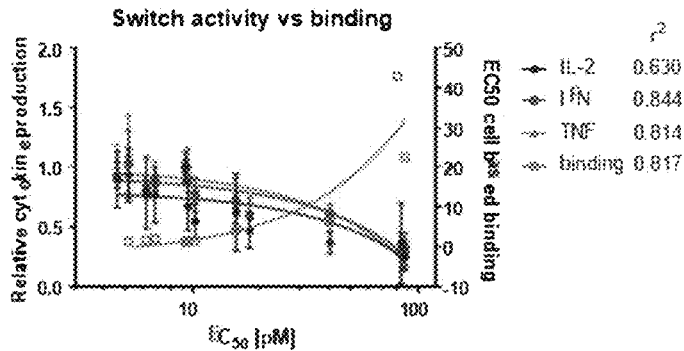
FIG. 22C
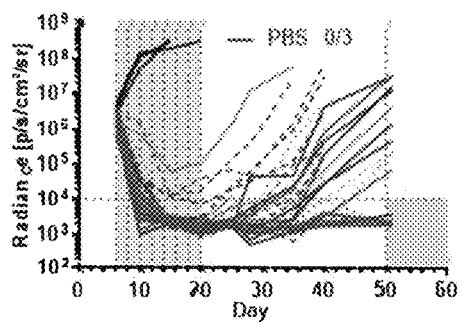
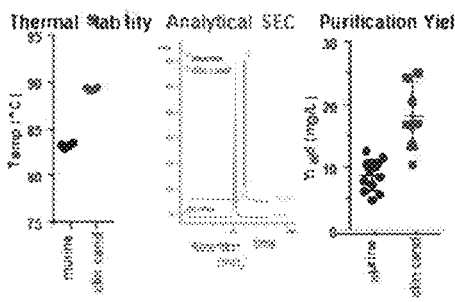
FIG. 22D
Developability analysis:
- High resolution MS
- Thermal stability
- *In silico* T cell epitopes
- Chromatography:
  - Revere Phase
  - HIC, SIC, CIC
  - Size exclusion

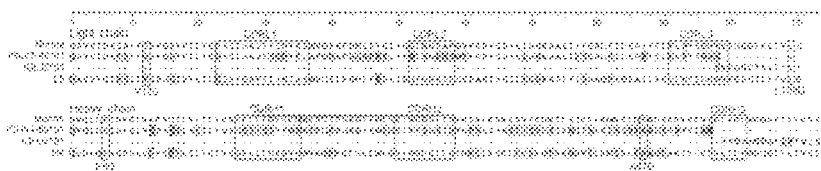
FIG. 27A
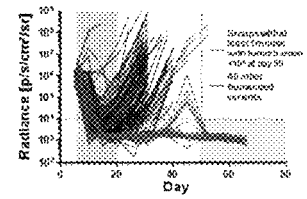
FIG. 27B
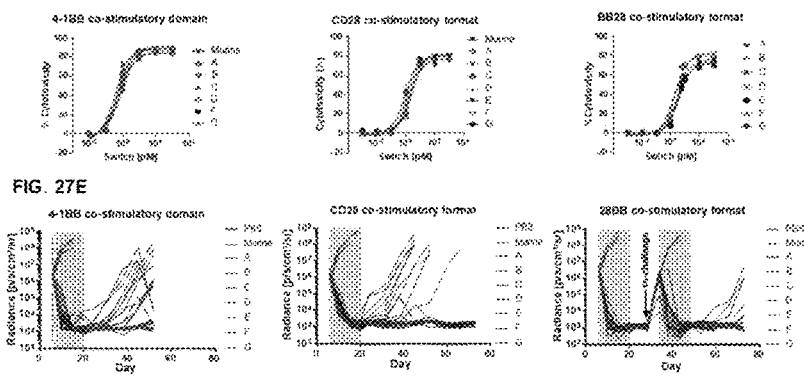
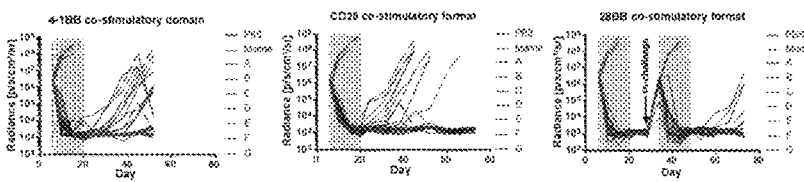

FIG. 28

Figure 1VH: Potential humanized sequences of Calibr GCN4 antibody S25R4 VH

Potential humanized sequence based on IMGT IGHV4-59*01 acceptor framework (AbM CDR definition)
4-59:     IMGT J00256|IGHJ4*01|YFDYWGQGTLVTVSS
Joining region

```
seq                    10         20         30         40         50         60         70         80         90
AbM                    b b b      p b b b    b b        b b l      i a b b    b l        b b b x    b b abc b  bibibb
S25R4        QVQLQESGPGLVAPSQSLSINCTVS GFLLIDIGVN WIRQPPGKGLEWLG YIYYSGSTN YNPSLKSRVTINSALKSRLSVTKLNSKQVFLKWNLQSGSARYYCAR
4-59         QVQLQESGPGLVKPSETLSLTCTVS GGSISSYYWS WIRQPPGKGLEWIG YIYYSGSTN YNPSLKSRVTISVDTSKNQFSLKLSSVTAADTAVYYCAR
hS25R4H1     QVQLQESGPGLVKPSETLSLTCTVS GFLLIDIGVN WIRQPPGKGLEWIG VINGDGITD YNPSLKSRVTISVDTRNQFSLKLSSVTAADTAVYYCAR
                                       *****     *            *****                              *
hS25R4H2     QVQLQESGPGLVKPSETLSLTCTVS GFLLIDIGVN WIRQPPGKGLEWIG VINGDGITD YNPSLKSRVTISRDTSKNQFSLKLSSVTAADTAVYYCAR
hS25R4H3     QVQLQESGPGLVKPSETLSLTCTVS GFLLIDIGVN WRQPPGKGLEWLG VINGDGITD YNPSLKSRVTISRDTRNQVSLKMSSLTAADTAVYYCAR
hS25R4H3b    QVQLQESGPGLVKPSETLSLTCTVS GFLLIDIGVN WRQPPGKGLEWLG VINGDGITD YNPSLKSRLTVSKLMSSKNQVSLKMSSLTAADTAVYYCAR
hS25R4H2b    QVQLQESGPGLVKPSETLSLTCTVS GFLLIDIGVN WIRQPPGKGLEWIG VINGDGITD YNPSLKSRVTISRDSERQFSLKLSSVTAADTAVYYCAR
                                                                                                  R
seq     100         110
AbM     103         110
        i b b b     * *
S25R4   GLFDY WGQGTLVTVSS
hS25R4H1 GLFDY WGQGTLVTVSS
hS25R4H2 GLFDY WGQGTLVTVSS
hS25R4H3 GLFDY WGQGTLVTVSS
hS25R4H3b GLFDY WGQGTLVTVSS
hS25R4H2b GLFDY WGQGTLVTVSS
```

(1) CDR sequences noted in bold. CDR definitions are from website www.bioinf.org.uk/abs/ and are either a combination of Kabat+AbM (seq) or solely AbM (AbM).
(2) Human germline and joining sequences from IMGT® the international ImMunoGeneTics® information system www.imgt.org (founder and director Marie-Paule Lefranc, Montpellier, France).
(3) Residue numbering shown as sequential (seq) or according to Chothia from website www.bioinf.org.uk/abs/ (AbM).
(4) "b" notes buried sidechain; "i" notes partially buried; "a" notes sidechain at interface between VH and VL domains.
(5) Sequence differences between human and murine germlines in frameworks noted by asterisk (*).
(6) Potential additional mutations in frameworks are noted below sequence.
(7) Potential changes in CDR sequences noted below each CDR sequence.

hS25R4H1 is a "CDR-swap" with no changes to human framework. Subsequent sequences alter framework changes shown in red (compared to sequence above it).

FIG. 29

Figure IVL: Potential humanized sequences of Calibr GCM4 antibody 528R4 VL

Potential humanized sequence based on IMGT IGLV7-46*01 acceptor framework (AbM CDR definition)
7-46 QAVVTQEPSLTVSPGGTVTLTC GSSTGAVTSGHYPY WFQQKPGQAPRTLIY DTSNKHS WTPARFSGSLLGGKAALTLSGAQPEDEAEYYC LLSYSGAR
joining region IMGT MIB641|IGLJ2*01| VVFGGGTKLTVL

```
seq        10         20              30         40         50              60         70         80         90
AbM        10         20              30abc      40         50              60         70         80         90
           b b b      b b b           b b   bl bl1 1 lbbl   1    b b         b b        b b b                xb b1b
SF34       QAVVTQEP-SLTVSPGGTVTLTC  RSSTGAVTSNYAN  WVQEKPDHLFTGLIG  GTNKRAP  GVPARFSGSLLGKAALTTGAQTEDEAIYFC
hum-VL5    QAVVTQEP-SLVVSPGGTVTLTC  RSSTGAVTSNYAN  WVQQKPDHLFTGLIG  GTNKRAP  GVPARFSGSLLGKAALTTGAQTEDEAIYFC
528R4      QAVVTQSS-ALASSPGKTVTLTC  RSSTGAVTSNYAS  WVQEKPDHLFTGLIG  DTSNKHS  WTPARFSGSLLGKAALTTGAQPEDEAEYYC
                                    *              * *              *        *
IGLV7-46   QAVVTQEP-SLTVSPGGTVTLTC  GSSTGAVTSGHYPY WFQQKPGQAPRTLIY DTSNKHS   WTPARFSGSLLGKAALTLSGAQPEDEAEYYC
h528R4L1   QAVVTQEP-SLTVSPGGTVTLTC  RSSTGAVTSNYAS  WFQQKPGQAPRTLIY DTSNKHS   WTPARFSGSLLGKAALTLSGAQPEDEAEYYC
h528R4L2   QAVVTQEP-SLTVSPGGTVTLTC  GSSTGAVTSNYAS  WVQQKPGQAPRLIG  GTNKRAP   GVPARFSGSLLGKAALTTSGAQPEDEAEYYC
h528R4L3   QAVVTQEP-SLTVSPGGTVTLTC  GSSTGAVTSNYAS  WVQQKPGQAPRLIG  GTNKRAP   GVPARFSGSLLGKAALTTSGAQPEDEAEYYC
h528R4L4   QAVVTQEP-SLTVSPGGTVTLTC  GSSTGAVTSNYAS  WVQQKPGQAPRLIG  GTNKRAP   GVPARFSGSLLGKAALTTSGAQPEDEAEYYC
                                                  ##                                   D                  I F seq        90         100
AbM        1b1  i1b  i  b b b
SF34       ALMYSNLWV  FGGGTKLTVL
hum-VL5    ALMYSNLWV  FGGGTKLTVL
528R4      VLMYTSDRWV FGGGTKLTVL
IGLV7-46   LLSYSGAR
h528R4L1   VLMYTSDRWV FGGGTKLTVL
h528R4L2   VLMYTSDRWV FGGGTKLTVL
h528R4L3   VLMYTSDRWV FGGGTKLTVL
h528R4L4   VLMYTSDRWV FGGGTKLTVL
```

(1) CDR sequences noted in bold. CDR definitions are from website www.bioinf.org.uk/abs/ and are either a combination of Kabat&AbM (seq) or solely AbM (AbM).
(2) Human germline and joining sequences from IMGT the international ImmunoGenetics information system www.imgt.org (founder and director: Marie-Paule Lefranc, Montpellier, France).
(3) Residue numbering shown as sequential (seq) or according to Chothia from website www.bioinf.org.uk/abs/ (AbM).
(4) "b" notes buried substance "i" notes surface sidechain at interface between VH and VL domains.
(5) sequence differences between human and murine germlines noted by asterisk (*).
(6) potential additional mutations in frameworks are noted below sequence.
(7) potential changes in CDR sequences noted below each CDR sequence. These may prevent asparagine (N) deamidation.

deamidation substitutions: Q/S/A/D h528R4L1 is a "CDR-swap" with no changes to human framework. Subsequent sequences alter framework changes shown in red (compared to sequence above it).

Crystal structure 1P4B, Three-Dimensional Structure Of a Single Chain Fv Fragment Complexed With The peptide GCN4(7P-14P).

Structure of the C11L34 variant of the anti-GCN4 scFv with the humanized equivalent residues of interested labeled

FIG. 38

| | name | scFv | hinge | TM | costim 1 | costim 2 | activation |
|---|---|---|---|---|---|---|---|
| | 1D3 CAR | anti-mCD19 | mCD28 | mCD28 | mCD28 | | mCD3ζ(1-3) |
| | H-1.109 | anti-GCN4 | mCD28 | mCD28 | mCD28 | | mCD3ζ(1-3) |
| Group 1 | SV-285-064 | anti-GCN4 | IgG4m | mCD28 | mCD28 | | mCD3ζ(1-3) |
| | SV-319-029 | anti-GCN4 | IgG4m | mCD28 | mCD28 | m4-1BB | mCD3ζ(1-3) |
| | SV-319-028 | anti-GCN4 | IgG4m | mCD28 | mCD28 | | mCD3ζ(1-3) |
| Group 2 | SV-319-090 | anti-GCN4 | IgG4m | mCD28 | mCD28 | | mCD3ζ intact |
| | SV-319-091 | anti-GCN4 | IgG4m | mCD28 | mCD28 | m4-1BB | mCD3ζ intact |
| | SV-319-092 | anti-GCN4 | IgG4m | mCD28 | mCD28 | m4-1BB | mCD3ζ intact |
| Group 3 | SV-319-162 | anti-GCN4 | mCD8 | mCD8 | mCD28 | | mCD3ζ(1-3) |
| | SV-1-003 | anti-GCN4 | mCD8 | mCD8 | mCD28 | m4-1BB | mCD3ζ(1-3) |
| | SV-319-163 | anti-GCN4 | mCD8 | mCD8 | mCD28 | m4-1BB | mCD3ζ(1-3) |
| Group 4 | YSV-319-088 | anti-GCN4 | mCD8 | mCD8 | mCD28 | | mCD3ζ intact |
| | SV-1-004 | anti-GCN4 | mCD8 | mCD8 | mCD28 | m4-1BB | mCD3ζ intact |
| | SV-319-089 | anti-GCN4 | mCD8 | mCD8 | mCD28 | m4-1BB | mCD3ζ intact |
| Group 5 | SV-319-164 | anti-GCN4 | IgG4m | mCD8 | mCD28 | | mCD3ζ(1-3) |
| | SV-1-001 | anti-GCN4 | IgG4m | mCD8 | mCD28 | m4-1BB | mCD3ζ(1-3) |
| | SV-319-165 | anti-GCN4 | IgG4m | mCD8 | mCD28 | m4-1BB | mCD3ζ(1-3) |
| Group 6 | SV-319-166 | anti-GCN4 | IgG4m | mCD28 | mCD28 | | mCD3ζ intact |
| | SV-1-002 | anti-GCN4 | IgG4m | mCD28 | mCD28 | m4-1BB | mCD3ζ intact |
| | SV-319-167 | anti-GCN4 | IgG4m | mCD28 | mCD28 | m4-1BB | mCD3ζ intact |
| Group 7 | | anti-GCN4 | mCD8 | mCD28 | mCD28 | | mCD3ζ(1-3) |
| | | anti-GCN4 | mCD8 | mCD28 | mCD28 | m4-1BB | mCD3ζ(1-3) |
| | | anti-GCN4 | mCD8 | mCD28 | mCD28 | m4-1BB | mCD3ζ(1-3) |
| Group 8 | | anti-GCN4 | mCD8 | mCD28 | mCD28 | | mCD3ζ intact |
| | | anti-GCN4 | mCD8 | mCD28 | mCD28 | m4-1BB | mCD3ζ intact |
| | | anti-GCN4 | mCD8 | mCD28 | mCD28 | m4-1BB | mCD3ζ intact |

CHIMERIC ANTIGEN RECEPTOR EFFECTOR CELL SWITCHES WITH HUMANIZED TARGETING MOIETIES AND/OR OPTIMIZED CHIMERIC ANTIGEN RECEPTOR INTERACTING DOMAINS AND USES THEREOF

CROSS-REFERENCE TO RELATED APPLICATIONS

This application is a continuation of U.S. patent application Ser. No. 16/343,353 (filed Apr. 18, 2019; now pending), which is a § 371 U.S. national phase filing of International Patent Application No. PCT US2017/057460 (filed, Oct. 19, 2017; now expired), which claims priority to U.S. Provisional Application No. 62/410,315 (filed Oct. 19, 2016). The full disclosures of the aforementioned priority applications are incorporated herein by reference in their entirety and for all purposes.

STATEMENT OF GOVERNMENT INTEREST

This invention was made with government support under grant number CA208398 awarded by the National Institute of Health. The government has certain rights in the invention.

BACKGROUND

Immunotherapies are becoming attractive alternatives to chemotherapies, including immunotherapies that use adoptive transfer of genetically modified T cells to "reteach" the immune system to recognize and eliminate malignant tumor cells. Genetically modified T cells express chimeric antigen receptors, which generally consist of a CD3-zeta signaling endodomain, a transmembrane domain, and an extracellular single-chain variable fragment (scFv) derived from a monoclonal antibody which gives the receptor specificity for a tumor-associated antigen on a target malignant cell. Upon binding the tumor-associated antigen via the chimeric antigen receptor, the chimeric antigen receptor expressing T cell (CAR T-cell) mounts an immune response that is cytotoxic to the malignant cell. Such therapies can circumvent chemotherapy resistance and have been shown to be active against relapsed/refractory disease, resulting in sustained remissions for chronic lymphocytic leukemia (CLL) and acute lymphoblastic leukemia (ALL) patients. However, these therapies require further investigation and optimization, as they caused undesirable effects such as cytokine release syndrome (CRS), toxic lymphopenia, chronic hypogammaglobulinemia for hematological targets, fatal on target off tumor cytolysis for solid tumor targets, cerebral edema, persistent B cell aplasia with the use of anti-CD19 antibody expressing CAR T-cells, and, in some cases, death.

SUMMARY OF THE EMBODIMENTS

The present disclosure provides compositions and methods for selectively activating and deactivating chimeric receptor effector cells (e.g., chimeric antigen receptor T cells), which may provide for a safer and more versatile immunotherapy than conventional CAR-T cell designs currently being tested in clinical trials by providing control over the therapy.

The present disclosure provides chimeric receptor effector cell switches (referred to as "switches," herein), including humanized switches, and switchable chimeric receptor effector cells. The present disclosure also provides chimeric receptor effector cells comprising a humanized switchable chimeric receptor. The present disclosure also provides humanized CAR-EC platforms comprising one or more humanized chimeric receptor effector cell switch and one or more chimeric receptor effector cell comprising a humanized switchable chimeric receptor.

In some embodiments, the present disclosure provides a humanized chimeric antigen receptor-effector cell (CAR-EC) switch comprising: a chimeric antigen receptor-interacting domain (CAR-ID) that interacts with a chimeric antigen receptor on the CAR-EC; and a humanized targeting moiety that binds CD19 on a target cell.

The targeting moiety may bind a cell surface molecule on target cell.

In some embodiments, the present disclosure provides a humanized chimeric antigen receptor (CAR) comprising an extracellular domain, a transmembrane domain an intracellular signaling domain; wherein the extracellular domain comprises a humanized anti-GCN4 scFv comprising a sequence selected from SEQ ID NOS: 290-388, and 423. In some embodiments, the scFv comprises the amino acid sequence SEQ ID NO: 322. In some embodiments, the scFv comprises an amino acid sequence that is at least 50%, at least 60%, at least 70%, at least 80%, at least 85%, at least 90%, at least 95%, at least 96%, at least 97%, at least 98%, or at least 99% identical to SEQ ID NO: 322. In some embodiments, the CAR comprises a structure selected from structures A-H in FIG. 22A. In some embodiments, the CAR comprises a structure according to structure E in FIG. 22A. In some embodiments, the CAR comprises a sequence selected from SEQ ID NOS: 389-397, 401, 403, 405, 407, 409, 411, 413, and 415. In some embodiments, the CAR comprises the amino acid sequence SEQ ID NO: 411. In some embodiments, the CAR comprises an amino acid sequence that is at least 50%, at least 60%, at least 70%, at least 80%, at least 85%, at least 90%, at least 95%, at least 96%, at least 97%, at least 98%, or at least 99% identical to sequence SEQ ID NO: 411. In some embodiments, the extracellular domain comprises a hinge domain comprising a sequence selected from SEQ ID NOS: 93-103 and 165-168. In some embodiments, the extracellular domain comprises a hinge domain comprising an amino acid sequence: ESKYGPPCPPCPD (SEQ ID NO:424); In some embodiments, the transmembrane domain comprises an amino acid sequence selected from SEQ ID NO: 398 and 417. In some embodiments, the intracellular signaling domain comprises (a) a CD3-zeta In some embodiments, the CD28 domain comprises an amino acid sequence that is at least 50%, at least 60%, at least 70%, at least 80%, at least 85%, at least 90%, at least 95%, at least 96%, at least 97%, at least 98%, or at least 99% identical to sequence SEQ ID NO: 418. In some embodiments, the CD28 domain comprises an amino acid sequence SEQ ID NO: 418. In some embodiments, the 4-1BB domain comprises an amino acid sequence that is at least 50%, at least 60%, at least 70%, at least 80%, at least 85%, at least 90%, at least 95%, at least 96%, at least 97%, at least 98%, or at least 99% identical to sequence SEQ ID NO: 419. In some embodiments, the 4-1BB domain comprises an amino acid sequence SEQ ID NO: 419. In some embodiments, the CD3-zeta domain comprises an amino acid sequence that is at least 50%, at least 60%, at least 70%, at least 80%, at least 85%, at least 90%, at least 95%, at least 96%, at least 97%, at least 98%, or at least 99% identical to sequence SEQ ID NO: 420. In some embodiments, the CD3-zeta domain comprises an amino acid sequence SEQ ID NO: 420. In some embodiments, the transmembrane domain comprises an amino acid sequence that is at least 50%, at least 60%, at least 70%, at least 80%, at least 85%, at least 90%, at least 95%, at least 96%, at least 97%, at least 98%, or at least 99% identical to sequence SEQ ID NO: 417. In some embodiments, the transmembrane domain comprises an amino acid sequence SEQ ID NO: 417.

In some embodiments, the present disclosure provides a humanized chimeric antigen receptor (CAR) comprising an extracellular domain, a transmembrane domain an intracellular signaling domain, wherein the extracellular domain comprises:
  a. a humanized region that interacts with a chimeric antigen receptor switch; and
  b. a hinge domain.

In some embodiments, the hinge domain is about one to about twenty amino acids long. In some embodiments, the hinge domain is greater than about 20 amino acids long. In some embodiments, the hinge domain is flexible. In some embodiments, the hinge domain is rigid. In some embodiments, the hinge domain is selected from an IgG4 hinge, an IgG4m hinge, a CD28 hinge, and a CD8 hinge. In some embodiments, the hinge domain comprises or consists of a sequence selected from SEQ ID NOS: 93-103 and 165-168. In some embodiments, the hinge domain comprises or consists of a sequence that is at least 50% homologous to a sequence selected from SEQ ID NOS: 93-103 and 165-168. In some embodiments, the extracellular domain comprises a humanized anti-GCN4 scFv. In some embodiments, the extracellular domain comprises a humanized 52SR4 antibody or an antigen binding portion thereof. In some embodiments, the humanized anti-GCN4 scFv comprises or consists of a sequence selected from SEQ ID NOS: 290-388, and 423. In some embodiments, the humanized anti-GCN4 scFv comprises or consists of a sequence that is at least 50% identical to a sequence selected from SEQ ID NOS: 290-388, and 423. In some embodiments, the humanized anti-GCN4 scFv comprises or consists of a sequence that is at least 50%, at least 60%, at least 70%, at least 80%, at least 85%, at least 90%, at least 95%, at least 96%, at least 97%, at least 98%, or at least 99% identical to SEQ ID NO: 322. In some embodiments, the CAR comprises a transmembrane domain selected from a CD8 transmembrane domain or a CD28 transmembrane domain. In some embodiments, the transmembrane domain comprises or consists of an amino acid sequence selected from SEQ ID NO: 398 and 417. In some embodiments, the intracellular signaling domain comprises (a) a CD3-zeta domain and (b) a CD28 domain; a 4-1BB domain; or a CD28 domain and a 4-1BB domain. In some embodiments, the CD28 domain comprises or consists of SEQ ID NO: 418. In some embodiments, the 4-1BB domain comprises or consists of SEQ ID NO: 419. In some embodiments, the CD3-zeta domain comprises or consists of SEQ ID NO: 420. In some embodiments, the region that interacts with a chimeric antigen receptor switch interacts with a chimeric antigen receptor binding peptide of the chimeric antigen receptor switch, wherein the chimeric antigen receptor switch further comprises targeting moiety that interacts with a cell surface molecule on the target. In some embodiments, the chimeric antigen receptor comprises a sequence selected from SEQ ID NOS: 389-397, 401, 403, 405, 407, 409, 411, 413, and 415. In some embodiments, the chimeric antigen receptor consists of a sequence selected from SEQ ID NOS: 389-397, 401, 403, 405, 407, 409, 411, 413, and 415. In some embodiments, the chimeric antigen receptor comprises or consists of an amino acid sequence that is at least 50%, at least 60%, at least 70%, at least 80%, at least 85%, at least 90%, at least 95%, at least 96%, at least 97%, at least 98%, or at least 99% identical to a sequence selected from SEQ ID NOS: 389-397, 401, 403, 405, 407, 409, 411, 413, and 415. In some embodiments, the chimeric antigen receptor is encoded by a sequence selected from SEQ ID NOS: 400, 402, 404, 406, 408, 410, 412, 414, and 416. In some embodiments, the chimeric antigen receptor is encoded by a sequence that is at least 50%, at least 60%, at least 70%, at least 80%, at least 85%, at least 90%, at least 95%, at least 96%, at least 97%, at least 98%, or at least 99% identical to SEQ ID NOS: 400, 402, 404, 406, 408, 410, 412, 414, and 416. In some embodiments, the amino acid sequence of the humanized region comprises or consists of SEQ ID NO: 322. In some embodiments, the hinge domain comprises or consists of the amino acid sequence ESKYGPPCPPCPD (SEQ ID NO:424). In some embodiments, the transmembrane domain comprises or consists of SEQ ID NO: 417. In some embodiments, the intracellular domain comprises a CD3-zeta signaling domain that comprises or consists of SEQ ID NO: 420. In some embodiments, the intracellular domain comprises a costimulatory domain that comprises or consists of SEQ ID NO: 418 or 419. In some embodiments, the intracellular domain comprises a first costimulatory domain that comprises or consists of SEQ ID NO: 418 and a second costimulatory domain that comprises or consists of SEQ ID NO: 419. In some embodiments, the chimeric antigen receptor comprises or consists of amino acid sequence SEQ ID NO: 411. In some embodiments, the chimeric antigen receptor comprises or consists of an amino acid sequence that is at least 50%, at least 60%, at least 70%, at least 80%, at least 85%, at least 90%, at least 95%, at least 96%, at least 97%, at least 98%, or at least 99% identical to a sequence SEQ ID NO: 411.

In some embodiments, the present disclosure provides a humanized chimeric antigen receptor-effector cell (CAR-EC) switch comprising:
  a. a chimeric antigen receptor-interacting domain (CAR-ID) comprising a GCN4 derivative peptide that interacts with an anti-GCN4 chimeric antigen receptor on the CAR-EC; and
  b. a targeting moiety;
  wherein the targeting moiety is a targeting antibody, or an antigen binding portion thereof, which comprises a light chain sequence selected from any one of SEQ ID NOS: 17-25, 27-35, 247, 249, 251, 253, 255, 257, 259, 261, 263, 265, and 267. In some embodiments, the targeting antibody, or the antigen binding portion thereof, comprises a heavy chain sequence selected from any one of SEQ ID NOS: 2-15, 248, 250, 252, 254, 256, 258, 260, 262, 264, 266, and 268.

In some embodiments, the present disclosure provides a chimeric antigen receptor-effector cell (CAR-EC) switch comprising:
  a. a chimeric antigen receptor-interacting domain (CAR-ID) comprising a GCN4 derivative peptide that interacts with an anti-GCN4 chimeric antigen receptor on the CAR-EC; and
  b. a targeting moiety;
  wherein the targeting moiety is a targeting antibody, or an antigen binding portion thereof, which comprises a heavy chain sequence selected from any one of SEQ ID NOS: 2-15, 248, 250, 252, 254, 256, 258, 260, 262, 264, 266, and 268. In some embodiments, the targeting antibody, or the antigen binding portion thereof, comprises a light chain sequence selected from any one of SEQ ID NOS: 17-25, 27-35, 247, 249, 251, 253, 255, 257, 259, 261, 263, 265, and 267. In some embodiments, the targeting moiety is a scFv. In some embodiments, the targeting moiety comprises a light chain sequence of SEQ ID NO: 30 and a heavy chain sequence of SEQ ID NO: 7. In some embodiments, the targeting moiety comprises a heavy chain sequence that is at least 85%, 90%, 95%, 96%, 97%, 98%, or at least 99% identical to SEQ ID NO: 7. In some embodiments, the targeting moiety comprises a light chain sequence that is at least 85%, 90%, 95%, 96%, 97%, 98%, or at least 99% identical to SEQ ID NO: 30. In some embodiments, the targeting moiety comprises a light chain/heavy chain sequence pair selected from (i) SEQ ID NO: 30/SEQ ID NO: 7; (ii) SEQ ID NO: 30/SEQ ID NO: 6; (iii) SEQ ID NO: 34/SEQ ID NO: 6; and (iv) SEQ ID NO: 34/SEQ ID NO: 7. In some embodiments, the targeting moiety comprises a light chain selected from any one of SEQ ID NOS: 17-25; wherein the CAR-EC switch comprises a CAR-ID that is a GCN4 peptide selected from any one of SEQ ID NOS: 26, 36, 139-163 and 245; and wherein the CAR-EC switch is a LCNT switch.

In some embodiments, the present disclosure provides a chimeric antigen receptor-effector cell (CAR-EC) switch comprising: a chimeric antigen receptor-interacting domain (CAR-ID) comprising a GCN4 derivative peptide that interacts with an anti-GCN4 chimeric antigen receptor on the CAR-EC; and a targeting moiety. In some embodiments, the GCN4 peptide derivative comprises a sequence of Structure I: X1NYHLENEVARLKX2X3 (SEQ ID NO: 269), wherein X1, X2, and X3 are optionally any amino acid or absent. In some embodiments, the GCN4 peptide derivative consists of a sequence of Structure I: X1NYHLENEVARLKX2X3 (SEQ ID NO: 269), wherein X1, X2, and X3 are optionally any amino acid or absent. In some embodiments, X1 is K or absent. In some embodiments, X2 is selected from K, A, and G. In some embodiments, X3 is selected from L, A, and G. In some embodiments, the GCN4 peptide derivative comprises a sequence selected from any one of SEQ ID NOS: 26, 36, 139, 145, and 154-163. In some embodiments, the GCN4 peptide derivative comprises a sequence selected from any one of SEQ ID NOS: 26, 36, 139-163 and 245. In some embodiments, the GCN4 peptide derivative consists of a sequence selected from any one of SEQ ID NOS: 26, 36, 139, 145, and 154-163. In some embodiments, the GCN4 peptide derivative consists of a sequence selected from any one of SEQ ID NOS: 26, 36, 139-163 and 245.

In some embodiments, the targeting moiety is a targeting polypeptide. In some embodiments, the targeting polypeptide is a targeting antibody or antibody fragment that binds an antigen on the target cell. In some embodiments, the targeting antibody or antigen binding portion thereof is humanized.

In some embodiments, the cell surface molecule is CD19. In some embodiments, the cell surface molecule is Her2, CLL1, CD33, CD123, EGFR, EGFRvIII, CD20, CD22, CS1, BCMA, CEA or a fragment thereof. In some particular embodiments, the targeting moiety specifically binds CD19. In some particular embodiments, the targeting moiety specifically binds Her2, CLL1, CD33, CD123, EGFR, EGFRvIII, CD20, CD22, CS1, BCMA, CEA or a fragment thereof.

In some particular embodiments, the targeting moiety is an anti-CD19 antibody, or an antigen binding portion thereof. In some embodiments, the targeting moiety comprises or consists of a humanized anti-CD19 antibody, or an antigen binding portion thereof (e.g., any one or more of the humanized anti-CD19 antibodies or antigen binding portions thereof disclosed herein). In some embodiments, the targeting moiety comprises or consists of a humanized FMC63 antibody, or an antigen binding portion of a humanized FMC63 antibody. In some embodiments, the targeting moiety comprises or consists of an anti-CD20 antibody, an anti-CD22 antibody, an anti-EGFR antibody, an anti-EGFRvIII antibody, an anti-Her2 antibody, an anti-CS1 antibody, an anti-BCMA antibody, an anti-CEA antibody, an anti-CLL1 antibody, an anti-CD123 antibody, or an anti-CD33 antibody. In some embodiments, the targeting moiety comprises or consists of a humanized anti-CD20 antibody, a humanized anti-CD22 antibody, a humanized anti-EGFR antibody, a humanized anti-EGFRvIII antibody, a humanized anti-Her2 antibody, a humanized anti-CS1 antibody, a humanized anti-BCMA antibody, a humanized anti-CEA antibody, a humanized anti-CLL1 antibody, a humanized anti-CD123 antibody, or a humanized anti-CD33 antibody.

In some embodiments, the targeting moiety (e.g., a humanized targeting moiety), is selected from the group consisting of: an immunoglobulin, an Fc null immunoglobulin, and a Fab, and fragments thereof.

In some embodiments, the humanized targeting moiety comprises a light chain sequence selected from the group consisting of SEQ ID NOS: 16-25. In some embodiments, the humanized targeting moiety comprises a light chain sequence selected from the group consisting of SEQ ID NOS: 27-35. In some embodiments, the humanized targeting moiety comprises a heavy chain sequence selected from the group consisting of SEQ ID NOS: 1-15. In some embodiments, the humanized targeting moiety comprises a light chain sequence selected from any one of SEQ ID NOS: 17-25, 247, 249, 251, 253, 255, 257, 259, 261, 263, 265, and 267. In some embodiments, the targeting moiety is a targeting antibody, or an antigen binding portion thereof, comprises a heavy chain sequence selected from any one of SEQ ID NOS: 2-15, 248, 250, 252, 254, 256, 258, 260, 262, 264, 266, and 268. In some embodiments, the targeting moiety is targeting antibody, or an antigen binding portion thereof, which comprises a light chain sequence selected from any one of SEQ ID NOS: 27-35. In some embodiments, the CAR-EC switch comprises a light chain sequence of SEQ ID NO: 30 and a heavy chain sequence of SEQ ID NO: 7. In some embodiments, the CAR-EC switch a light chain sequence that is at least 85%, 90%, 95%, 96%, 97%, 98%, or at least 99% identical to SEQ ID NO: 30 and a heavy chain sequence that is at least 85%, 90%, 95%, 96%, 97%, 98%, or at least 99% identical to SEQ ID NO: 7. In some embodiments, the CAR-EC switch a light chain/heavy chain sequence pair selected from (i) SEQ ID NO: 30/SEQ ID NO: 6; (ii) SEQ ID NO: 34/SEQ ID NO: 6; and (iii) SEQ ID NO: 34/SEQ ID NO: 7.

In some embodiments, the humanized targeting moiety comprises a light chain sequence that differs from SEQ ID NO: 35 in from about one to about twenty amino acids. In some embodiments, the humanized targeting moiety comprises a light chain sequence that is identical to SEQ ID NO: 35 except that it comprises a substitution of one or more of the SEQ ID NO: 35 light chain amino acid residues selected from the group consisting of T7, T8, L15, S22, D41, G42, T43, V44, Y71, S72, N77, E79, Q80, I83, F87, and G100.

In some embodiments, the humanized targeting moiety comprises a heavy chain sequence that differs from SEQ ID NO: 15 in from about one to about thirty amino acids. In some embodiments, the humanized targeting moiety comprises a heavy chain sequence that is identical to SEQ ID NO: 15 except that it comprises a substitution of one or more of the SEQ ID NO: 15 heavy chain amino acid residues selected from the group consisting of E1, K3, A13, Q16, S17, V20, R42, L48, S61, A62, L67, I70, K71, N73, S76, V78, F79, M82, N83, L85, Q86, T87, D88, I92, K97, and S115.

In some embodiments, the targeting moiety comprises a targeting antibody, or an antigen binding portion thereof, which comprises a light chain sequence disclosed herein. In some embodiments, the targeting moiety comprises a targeting moiety that is a targeting antibody, or an antigen binding portion thereof, which comprises a heavy chain sequence disclosed herein. In some embodiments, the targeting moiety comprises a targeting antibody, or an antigen binding portion thereof, which comprises a light chain sequence and a heavy chain sequence disclosed herein. In some embodiments, the targeting moiety comprises a targeting antibody, or an antigen binding portion thereof, which comprises a light chain sequence selected from any one of SEQ ID NOS: 17-25, 247, 249, 251, 253, 255, 257, 259, 261, 263, 265, and 267. In some embodiments, the targeting moiety comprises a targeting antibody, or an antigen binding portion thereof, which comprises a heavy chain sequence selected from any one of SEQ ID NOS: 2-15, 248, 250, 252, 254, 256, 258, 260, 262, 264, 266, and 268. In some embodiments, the targeting moiety comprises a targeting antibody, or an antigen binding portion thereof, which comprises a light chain sequence selected from any one of SEQ ID NOS: 27-35. In some embodiments, the targeting moiety comprises a heavy chain sequence selected from any one of 2-15, 248, 250, 252, 254, 256, 258, 260, 262, 264, 266, and 268.

In some embodiments, CAR-ID comprises a peptide. In some embodiments, CAR-ID comprises a peptide selected from a yeast transcription factor GCN4 peptide, a variant GCN4 peptide that does not dimerize; a flag tag peptide; a non-naturally occurring peptide, a naturally occurring peptide, a synthetic peptide tag, an alpha helix-forming peptide, a K4 peptide, and an E4 peptide. In some embodiments, the GCN4 peptide derivative comprises a sequence of Structure I: X1NYHLENEVARLKX2X3 (SEQ ID NO: 269), wherein X1, X2, and X3 are optionally any amino acid or absent. In some embodiments, the GCN4 peptide derivative consists of a sequence of Structure I: X1NYHLENEVARLKX2X3 (SEQ ID NO: 269), wherein X1, X2, and X3 are optionally any amino acid or absent. In some embodiments, X1 is K or absent. In some embodiments, X2 is selected from K, A, and G. In some embodiments, X3 is selected from L, A, and G. In some embodiments, the GCN4 peptide derivative comprises a sequence selected from any one of SEQ ID NOS: 26, 36, 139-163 and 245. In some embodiments, the GCN4 peptide derivative consists of a sequence selected from any one of SEQ ID NOS: 26, 36, 139-163 and 245.

In some embodiments, CAR-ID comprises a small molecule. In some embodiments, the small molecule is a hapten. In some embodiments, the hapten is FITC.

In some embodiments, the present disclosure provides a kit comprising a CAR-EC switch disclosed herein and a "complementary" chimeric antigen receptor (CAR) expressed on a CAR-EC. In some embodiments, the kit comprises (i) a humanized CAR-EC switch comprising: a CAR-ID that interacts with a chimeric antigen receptor on the CAR-EC and a humanized targeting moiety that binds CD19 on a target cell and (ii) a complementary CAR expressed on a CAR-EC. In some embodiments, the kit comprises a CAR-ID selected from a yeast transcription factor GCN4 peptide or derivative thereof, a variant GCN4 peptide that does not dimerize; a flag tag peptide; a non-naturally occurring peptide, a naturally occurring peptide, a synthetic peptide tag, an alpha helix-forming peptide, a K4 peptide, and an E4 peptide. In some embodiments, the CAR-ID is FITC.

In some embodiments, the present disclosure provides a kit comprising a first humanized CAR-EC switch selected from any one of the CAR-EC switches disclosed herein and a first CAR-EC. In some embodiments, the first CAR-EC comprises a humanized CAR. In some embodiments, the humanized CAR is selected from any one of the humanized CARs disclosed herein. In some embodiments, the humanized CAR is selected from SEQ ID Nos 389-397, 401, 403, 405, 407, 409, 411, 413, and 415. In some embodiments, the CAR-EC switch comprises a light chain sequence selected from any one of SEQ ID NOS: 17-25, 27-35, 247, 249, 251, 253, 255, 257, 259, 261, 263, 265, and 267 and a heavy chain sequence selected from any one of SEQ ID NOS: 2-15, 248, 250, 252, 254, 256, 258, 260, 262, 264, 266, and 268.

In some embodiments, the present disclosure provides a kit comprising (i) a CAR-EC expressing a CAR comprising an anti-GCN4 extracellular region (e.g., an anti-GCN4 antibody or a GCN4-binding portion thereof, disclosed herein) and (ii) a CAR-EC switch comprising: a CAR-ID comprising a GCN4 derivative peptide that interacts with the anti-GCN4 CAR on the CAR-EC; and a targeting moiety. In some embodiments, the GCN4 derivative is selected from any one of the GCN4 derivatives disclosed herein. In some embodiments, the GCN4 derivative does not dimerize. In some embodiments, the targeting moiety comprises a targeting moiety selected from the targeting moieties disclosed herein. In some particular embodiments, the targeting moiety is an anti-CD19 antibody, or an antigen binding portion thereof. In some embodiments, the targeting moiety comprises or consists of a humanized anti-CD19 antibody, or an antigen binding portion thereof (e.g., any one or more of the humanized anti-CD19 antibodies or antigen binding portions thereof disclosed herein). In some embodiments, the targeting moiety comprises or consists of a humanized FMC63 antibody, or an antigen binding portion of a humanized FMC63 antibody. In some embodiments, the targeting moiety comprises or consists of an anti-CD20 antibody, an anti-CD22 antibody, an anti-CD23 antibody an anti-EGFR antibody, an anti-EGFRvIII antibody, an anti-Her2 antibody, an anti-CS1 antibody, an anti-BCMA antibody, an anti-CEA antibody, an anti-CLL1 antibody, an anti-CD123 antibody, or an anti-CD33 antibody. In some embodiments, the targeting moiety comprises or consists of a humanized anti-CD20 antibody, a humanized anti-CD22 antibody, a humanized anti-EGFR antibody, a humanized anti-EGFRvIII antibody, a humanized anti-Her2 antibody, a humanized anti-CS1 antibody, a humanized anti-BCMA antibody, a humanized anti-CEA antibody, a humanized anti-CLL1 antibody, a humanized anti-CD123 antibody, or a humanized anti-CD33 antibody.

In some embodiments, the kit comprises a CAR-EC switch comprising a targeting moiety that is an FMC63 antibody, or a CD19-binding portion thereof, which comprises (i) a light chain sequence selected from the group consisting of SEQ ID NOS: 16-25 and (ii) a heavy chain sequence selected from the group consisting of SEQ ID NOS: 1-15. In some embodiments, the targeting moiety comprises a targeting antibody, or an antigen binding portion thereof, which comprises a light chain sequence disclosed herein. In some embodiments, the targeting moiety comprises a targeting moiety that is a targeting antibody, or an antigen binding portion thereof, which comprises a heavy chain sequence disclosed herein. In some embodiments, the targeting moiety comprises a targeting antibody, or an antigen binding portion thereof, which comprises a light chain sequence and a heavy chain sequence disclosed herein. In some embodiments, the targeting moiety comprises a targeting antibody, or an antigen binding portion thereof, which comprises a light chain sequence selected from any one of SEQ ID NOS: 17-25, 247, 249, 251, 253, 255, 257, 259, 261, 263, 265, and 267. In some embodiments, the targeting moiety comprises a targeting antibody, or an antigen binding portion thereof, which comprises a heavy chain sequence selected from any one of SEQ ID NOS: 2-15, 248, 250, 252, 254, 256, 258, 260, 262, 264, 266, and 268. In some embodiments, the targeting moiety comprises a targeting antibody, or an antigen binding portion thereof, which comprises a light chain sequence selected from any one of SEQ ID NOS: 27-35. In some embodiments, the targeting moiety comprises a heavy chain sequence selected from any one of SEQ ID NOS: 2-15, 248, 250, 252, 254, 256, 258, 260, 262, 264, 266, and 268.

In some embodiments, the kit is used for treating a subject in need thereof. In some embodiments, the subject is treated with the kit for a disease or condition for which CD19+ cells are implicated in pathology. In some embodiments, the kit is used to treat a subject for a disease or condition selected from heterogeneous tumors and blood cell malignancies. In some embodiments, the subject is treated for a disease or condition selected from acute lymphoblastic leukemia, acute myeloid leukemia, and chronic lymphocytic leukemia. In some embodiments, the subject is treated for a disease or condition selected from multiple myeloma, Hodgkins lymphoma, Non-hodgkins lymphoma (NHL), Diffuse large B cell lymphoma (DLBCL), Follicular lymphomas, Mantle cell lymphoma (MCL), Burkitt lymphoma, and Hairy cell leukemia (HCL). In some embodiments, the subject is treated for a disease or condition for which CD19+ cells are implicated in pathology comprising administering an anti-CD19 CAR-EC switch and a CAR-EC expressing a complementary CAR. In some embodiments, the kit is used for (i) treating a subject for a disease or condition for which CD20+ cells are implicated in pathology; (ii) treating a subject for a disease or condition for which CD22+ cells are implicated in pathology; (iii) treating a subject for a disease or condition for which CD33+ cells are implicated in pathology; (iv) treating a subject for a disease or condition for which CEA+ cells are implicated in pathology; (v) treating a subject for a disease or condition for which CLL1+ cells are implicated in pathology; (vi) treating a subject for a disease or condition for which BCMA+ cells are implicated in pathology; (vii) treating a subject for a disease or condition for which CS1+ cells are implicated in pathology; (viii) treating a subject for a disease or condition for which CD123+ cells are implicated in pathology; treating a subject for a disease or condition for which Her2+ cells are implicated in pathology; or (ix) treating a subject for a disease or condition for which a particular target antigen (e.g., a tumor associated antigen) is implicated in pathology.

In some embodiments, the present disclosure provides a method of treating a subject in need thereof with a switch disclosed herein and a complimentary CAR expressed on a CAR-EC. In some embodiments, the present disclosure provides a method of treating a subject in need thereof with (i) a humanized CAR-EC switch comprising: a CAR-ID that interacts with a chimeric antigen receptor on the CAR-EC and a humanized targeting moiety that binds CD19 on a target cell and (ii) a complementary CAR expressed on a CAR-EC. In some embodiments, the CAR-EC switch used in the method comprises a CAR-ID selected from a yeast transcription factor GCN4 peptide or derivative thereof, a GCN4 peptide that does not dimerize; a flag tag peptide; a non-naturally occurring peptide, a naturally occurring peptide, a synthetic peptide tag, an alpha helix-forming peptide, a K4 peptide, and an E4 peptide. In some embodiments, the GCN4 derivative does not dimerize. In some embodiments, the GCN4 derivative is selected from any one of the GCN4 derivatives disclosed herein. In some embodiments, the GCN4 peptide derivative comprises a sequence of Structure I: X1NYHLENEVARLKX2X3 (SEQ ID NO: 269), wherein X1, X2, and X3 are optionally any amino acid or absent. In some embodiments, the GCN4 peptide derivative consists of a sequence of Structure I: X1NYHLENEVARLKX2X3 (SEQ ID NO: 269), wherein X1, X2, and X3 are optionally any amino acid or absent. In some embodiments, X1 is K or absent. In some embodiments, X2 is selected from K, A, and G. In some embodiments, X3 is selected from L, A, and G. In some embodiments, the GCN4 peptide derivative comprises a sequence selected from any one of SEQ ID NOS: 26, 36, 139, 145, and 154-163. In some embodiments, the GCN4 peptide derivative comprises a sequence selected from any one of SEQ ID NOS: 26, 36, 139-163 and 245. In some embodiments, the GCN4 peptide derivative consists of a sequence selected from any one of SEQ ID NOS: 26, 36, 139, 145, and 154-163. In some embodiments, the GCN4 peptide derivative consists of a sequence selected from any one of SEQ ID NOS: 26, 36, 139-163 and 245.

In some embodiments, the CAR-ID is FITC.

In some embodiments, the present disclosure provides a method of treating a subject in need thereof with (i) a CAR-EC expressing a CAR comprising an anti-GCN4 extracellular region (e.g., an anti-GCN4 antibody or a GCN4-binding portion thereof, disclosed herein) and (ii) a CAR-EC switch comprising: a CAR-ID comprising a GCN4 derivative peptide that interacts with the anti-GCN4 CAR on the CAR-EC; and a targeting moiety. In some embodiments, the GCN4 derivative does not dimerize. In some embodiments, the GCN4 derivative is selected from any one of the GCN4 derivatives disclosed herein. In some embodiments, the GCN4 peptide derivative comprises a sequence of Structure I: X1NYHLENEVARLKX2X3 (SEQ ID NO: 269), wherein X1, X2, and X3 are optionally any amino acid or absent. In some embodiments, the GCN4 peptide derivative consists of a sequence of Structure I: X1NYHLENEVARLKX2X3 (SEQ ID NO: 269), wherein X1, X2, and X3 are optionally any amino acid or absent. In some embodiments, X1 is K or absent. In some embodiments, X2 is selected from K, A, and G. In some embodiments, X3 is selected from L, A, and G. In some embodiments, the GCN4 peptide derivative comprises a sequence selected from any one of SEQ ID NOS: 26, 36, 139, 145, and 154-163. In some embodiments, the GCN4 peptide derivative comprises or consists of a sequence selected from any one of SEQ ID NOS: 26, 36, 139-163 and 245.

In some embodiments, the GCN4 peptide derivative consists of a sequence selected from any one of SEQ ID NOS: 26, 36, 139, 145, and 154-163.

In some embodiments, the targeting moiety comprised of the CAR-EC switch used in the method of treating a subject in need thereof comprises a targeting moiety selected from the targeting moieties disclosed herein. In some particular embodiments, the targeting moiety is an anti-CD19 antibody, or an antigen binding portion thereof. In some embodiments, the targeting moiety comprises or consists of a humanized anti-CD19 antibody, or an antigen binding portion thereof (e.g., any one or more of the humanized anti-CD19 antibodies or antigen binding portions thereof disclosed herein). In some embodiments, the targeting moiety comprises or consists of a humanized FMC63 antibody, or an antigen binding portion of a humanized FMC63 antibody. In some embodiments, the targeting moiety comprises or consists of an anti-CD20 antibody, an anti-CD22 antibody, an anti-EGFR antibody, an anti-EGFRvIII antibody, an anti-Her2 antibody, an anti-CS1 antibody, an anti-BCMA antibody, an anti-CEA antibody, an anti-CLL1 antibody, an anti-CD123 antibody, or an anti-CD33 antibody. In some embodiments, the targeting moiety comprises or consists of a humanized anti-CD20 antibody, a humanized anti-CD22 antibody, a humanized anti-EGFR antibody, a humanized anti-EGFRvIII antibody, a humanized anti-Her2 antibody, a humanized anti-CS1 antibody, a humanized anti-BCMA antibody, a humanized anti-CEA antibody, a humanized anti-CLL1 antibody, a humanized anti-CD123 antibody, or a humanized anti-CD33 antibody.

In some embodiments, the targeting moiety comprised of the CAR-EC switch used in the method of treating a subject in need thereof comprises a targeting moiety that is an FMC63 antibody, or a CD19-binding portion thereof, which comprises (i) a light chain sequence selected from the group consisting of SEQ ID NOS: 16-25 or a light chain sequence selected from the group consisting SEQ ID NOS: 27-35; and (ii) a heavy chain sequence selected from the group consisting of SEQ ID NOS: 1-15.

In some embodiments, the method comprises treating a subject for a disease or condition for which CD19+ cells are implicated in pathology comprising administering an anti-CD19 CAR-EC switch and a CAR-EC expressing a complementary CAR. In some embodiments, the method comprises a. treating a subject for a disease or condition for which CD20+ cells are implicated in pathology; in some embodiments, the method comprises b. treating a subject for a disease or condition for which CD22+ cells are implicated in pathology; in some embodiments, the method comprises c. treating a subject for a disease or condition for which CD33+ cells are implicated in pathology; in some embodiments, the method comprises d. treating a subject for a disease or condition for which CEA+ cells are implicated in pathology; in some embodiments, the method comprises e. treating a subject for a disease or condition for which CLL1+ cells are implicated in pathology; in some embodiments, the method comprises f. treating a subject for a disease or condition for which BCMA+ cells are implicated in pathology; in some embodiments, the method comprises g. treating a subject for a disease or condition for which CS1+ cells are implicated in pathology; in some embodiments, the method comprises h. treating a subject for a disease or condition for which CD123+ cells are implicated in pathology; in some embodiments, the method comprises treating a subject for a disease or condition for which Her2+ cells are implicated in pathology; or treating a subject for a disease or condition for which a particular target antigen (e.g., a tumor antigen) is implicated in pathology. In some embodiments, the method comprises a. treating a subject for a disease or condition selected from heterogeneous tumors and blood cell malignancies. In some embodiments, the method comprises treating a subject for disease or condition selected from acute lymphoblastic leukemia, acute myeloid leukemia, and chronic lymphocytic leukemia. In some embodiments, the method comprises treating a subject for disease or condition selected from multiple myeloma, Hodgkins lymphoma, Non-hodgkins lymphoma (NHL), Diffuse large B cell lymphoma (DLBCL), Follicular lymphomas, Mantle cell lymphoma (MCL), Burkitt lymphoma, and Hairy cell leukemia (HCL). In some embodiments, the method comprises administering at least one switch disclosed herein and a complimentary CAR-EC.

In some embodiments, the present disclosure provides a pharmaceutical composition comprising a CAR-EC switch disclosed and one or more pharmaceutically acceptable salts, excipients and/or vehicles. In some embodiments, the pharmaceutical composition comprises carriers, excipients, diluents, antioxidants, preservatives, coloring, flavoring and diluting agents, emulsifying agents, suspending agents, solvents, fillers, bulking agents, buffers, delivery vehicles, tonicity agents, co-solvents, wetting agents, complexing agents, buffering agents, antimicrobials, and/or surfactants and one or more CAR-EC switch disclosed herein. In some embodiments, the pharmaceutical composition comprises at least two CAR-EC switches, wherein at least one of the switches is a switch disclosed herein, and one or more pharmaceutically acceptable salts, excipients or vehicles. In some embodiments, the pharmaceutical composition comprises two or more switches disclosed herein.

In some embodiments, the present disclosure provides a CAR-EC expressing a CAR selected from any one of the CAR disclosed herein. In some embodiments, the CAR comprises an extracellular domain, a transmembrane domain an intracellular signaling domain; wherein the extracellular domain comprises a humanized anti-GCN4 scFv comprising a sequence selected from SEQ ID NOS: 290-388, and 423. In some embodiments, the scFv comprises the amino acid sequence SEQ ID NO: 322. In some embodiments, the scFv comprises an amino acid sequence that is at least 50%, at least 60%, at least 70%, at least 80%, at least 85%, at least 90%, at least 95%, at least 96%, at least 97%, at least 98%, or at least 99% identical to SEQ ID NO: 322. In some embodiments, the CAR comprises a structure selected from structures A-H in FIG. 22A. In some embodiments, the CAR comprises a structure according to structure E in FIG. 22A. In some embodiments, the CAR comprises a sequence selected from SEQ ID NOS: 389-397, 401, 403, 405, 407, 409, 411, 413, and 415. In some embodiments, the CAR comprises the amino acid sequence SEQ ID NO: 411. In some embodiments, the CAR comprises an amino acid sequence that is at least 50%, at least 60%, at least 70%, at least 80%, at least 85%, at least 90%, at least 95%, at least 96%, at least 97%, at least 98%, or at least 99% identical to sequence SEQ ID NO: 411. In some embodiments, the CAR-EC is a T cell.

In some embodiments, the present disclosure provides a method of treating relapsed cancer, comprising administering to a subject: a first CAR-EC switch disclosed herein; a second CAR-EC switch comprising a CAR-ID and a targeting moiety; and a CAR-EC that binds the CAR-ID on the first CAR-EC switch and the CAR-ID on the second CAR-EC switch, wherein the first CAR-EC is administered before a relapse of the subject and the second CAR-EC switch is administered after the relapse of the subject. In some embodiments, the second CAR-EC switch comprises an anti-CD20 targeting moiety. In some embodiments, the targeting moiety of the first CAR-EC switch comprises a targeting antibody, or an antigen binding portion thereof, which comprises a light chain sequence selected from any one of SEQ ID NOS: 27-35 and a heavy chain sequence selected from any one of SEQ ID NOS: 2-15, 248, 250, 252, 254, 256, 258, 260, 262, 264, 266, and 268.

In some embodiments, the present disclosure provides a method of treating relapsed cancer, comprising administering to a subject: a first CAR-EC switch comprising a CAR-ID and a targeting moiety; a second CAR-EC switch selected from any one of the switches disclosed herein; and a CAR-EC that binds the CAR-ID on the first CAR-EC switch and the CAR-ID on the second CAR-EC switch, wherein the first CAR-EC is administered before a relapse of the subject and the second CAR-EC switch is administered after the relapse of the subject. In some embodiments, the targeting moiety of the second CAR-EC switch comprises a targeting antibody, or an antigen binding portion thereof, which comprises a light chain sequence selected from any one of SEQ ID NOS: 27-35 and a heavy chain sequence selected from any one of SEQ ID NOS: 2-15, 248, 250, 252, 254, 256, 258, 260, 262, 264, 266, and 268.

In some embodiments, the present disclosure provides a method of lysing a target cell, comprising contacting the target cell with a humanized CAR-EC switch disclosed herein and contacting the CAR-EC switch with a complementary CAR-EC. In some embodiments, the present disclosure provides a method of lysing a target cell, comprising contacting the target cell with a CAR-EC switch and contacting the CAR-EC switch with a complementary humanized CAR-EC disclosed herein.

In some embodiments, the present disclosure provides a method of killing a target cell, comprising contacting the target cell with a humanized CAR-EC switch disclosed herein and contacting the CAR-EC switch with a complementary CAR-EC In some embodiments, the present disclosure provides a method of killing a target cell, comprising contacting the target cell with a CAR-EC switch and contacting the CAR-EC switch with a complementary humanized CAR-EC disclosed herein.

In some embodiments, the present disclosure provides a method of activating a CAR-EC comprising contacting a CAR expressed on the CAR-EC with a CAR-EC switch selected from any one of the CAR-EC switches described herein, wherein the CAR-EC is activated when the targeting moiety on the CAR-EC switch is bound to both its target on the target cell and to the extracellular domain of the CAR on the CAR-EC, wherein the CAR binds to the CAR-ID on the CAR-EC switch.

In some embodiments, the present disclosure provides a method of controlling the magnitude of a T cell response by modulating the dosing regimen of a CAR-EC switch administration to a subject. In some embodiments, the first dosing regimen comprises administering a CAR-EC switch at a first high dose on a first short dosing schedule and a second dosing regimen comprises administering a CAR-EC switch at a second low dose on a second dosing schedule that is longer than the first dosing schedule. In some embodiments, the first dosing schedule comprises administering the CAR-EC switch at least once every other day. In some embodiments, the first dosing schedule comprises administering the CAR-EC switch every other day. In some embodiments, the first dosing schedule comprises administering the first high dose of the CAR-EC switch every other day for a total of four administrations. In some embodiments, the first dosing schedule comprises administering the first high dose of the CAR-EC switch every other day or about every other day for a total of four administrations or a total of about four administrations. In some embodiments, the second dosing schedule comprises administering the second low dose every other day for a total of twelve administrations. In some embodiments, the second dosing schedule comprises administering the second low dose every other day or about every other day for a total of twelve administrations or about twelfth administrations. In some embodiments, the high dose is at least 5 fold, 10 fold, or at least 15 fold that of a low dose. In some embodiments, the first dosing regimen results in increased T cell expansion in a subject administered the high dose as compared to the T cell expansion in a subject administered the low dose. In some embodiments, the CAR-EC switch is a humanized CAR-EC switch disclosed herein. In some embodiments, the CAR-EC switch comprises a targeting antibody, or an antigen binding portion thereof, which comprises a light chain sequence selected from any one of SEQ ID NOS: 27-35 and a heavy chain sequence selected from any one of SEQ ID NOS: 2-15, 248, 250, 252, 254, 256, 258, 260, 262, 264, 266, and 268. In some embodiments, the T cell comprises a CAR described herein. In some embodiments, the T cell comprises a humanized CAR comprising an extracellular domain, a transmembrane domain an intracellular signaling domain; wherein the extracellular domain comprises a humanized anti-GCN4 scFv comprising a sequence selected from SEQ ID NOS: 290-388, and 423. In some embodiments, the scFv comprises the amino acid sequence SEQ ID NO: 322. In some embodiments, the scFv comprises an amino acid sequence that is at least 50%, at least 60%, at least 70%, at least 80%, at least 85%, at least 90%, at least 95%, at least 96%, at least 97%, at least 98%, or at least 99% identical to SEQ ID NO: 322. In some embodiments, the CAR comprises a structure selected from structures A-H in FIG. 22A. In some embodiments, the CAR comprises a structure according to structure E in FIG. 22A. In some embodiments, the CAR comprises a sequence selected from SEQ ID NOS: 389-397, 401, 403, 405, 407, 409, 411, 413, and 415. In some embodiments, the CAR comprises the amino acid sequence SEQ ID NO: 411. In some embodiments, the CAR comprises an amino acid sequence that is at least 50%, at least 60%, at least 70%, at least 80%, at least 85%, at least 90%, at least 95%, at least 96%, at least 97%, at least 98%, or at least 99% identical to sequence SEQ ID NO: 411. In some embodiments, the extracellular domain comprises a hinge domain comprising a sequence selected from SEQ ID NOS: 93-103 and 165-168.

BRIEF DESCRIPTION OF THE DRAWINGS

FIGS. 1A-1B: show an alignment of the Heavy Chain sequences of various exemplary huFMC Fabs that may be used as CAR-EC switches of the present disclosure. Sequences shown in FIG. 1A are SEQ ID NOs:1-15, respectively. Sequences shown in FIG. 1B are SEQ ID NO:15 ("FMC") and SEQ ID NOs:1-6, respectively.

FIGS. 2A-2B: show an alignment of the Light Chain sequences of various exemplary huFMC Fabs that may be used as CAR-EC switches of the present disclosure. Sequences shown in FIG. 2A are SEQ ID NOs:16-25, respectively. Sequences shown in FIG. 2B are SEQ ID NO:25 ("FMC") and SEQ ID NOs:16-18, respectively.

FIGS. 17A-17D exemplify CAR hinge and CAR switch optimization. FIG. 17A shows an example of switchable CAR-T cell and formation of a monovalent immunological synapse from a monovalent switch and a monovalent CAR. FIG. 17B shows an example of switchable CAR-T cell and formation of a bivalent immunological synapse from a bivalent switch and a monovalent CAR. FIG. 17C shows an example of switchable CAR-T cell and formation of a bivalent immunological synapse from a monovalent switch and a bivalent CAR. FIG. 17D shows an example of switchable CAR-T cell and formation of a bivalent immunological synapse from a bivalent switch and a bivalent CAR. Relative activity of switchable CAR-T cells is shown by (+) signs below each of FIGS. 17A-D.

FIGS. 22A-22D show humanization of anti-CD19 switch. FIG. 22A shows $EC_{50}$ of cytotoxicity with humanized switch variants against RS4;11 cells. N=4, significance measured by one-way ANOVA. FIG. 22B shows correlation between cytokine production, binding affinity, and $EC_{50}$ of cytotoxicity. FIG. 22C shows a NALM-6 xenograft model. Tumor burden was established by injecting NSG mice iv with $0.5 \times 10^6$ NALM-6 cells. Six days later, $20 \times 10^6$ sCAR-T cells were injected, followed by 8 doses of humanized switch administered every other day over the period of 14 days (experiment 1: 0.5 mg/kg, solid lines; experiment 2: 0.05 mg/kg, dashed lines). N=3. FIG. 22D shows thermal stability (N=4), analytical size exclusion chromatograph (SEC), and purification yields (N=8-12) of murine switch and humanized switch candidate L2b/H4c.

FIG. 23 shows a sequence alignment of the heavy and light chains of the humanized candidate L2b/H4c with the humanized framework regions and the murine FMC63 sequence. The 4 heavy chain sequences shown are SEQ ID NO:15 ("Murine"), SEQ ID NO:1 ("IGHV4-59*01"), SEQ ID NO:436 ("IGHJ4*01"), and SEQ ID NO:6 ("H4c"), respectively. The 4 light chain sequences shown are SEQ ID NO:25 ("Murine"), SEQ ID NO:16 ("IGKV1-39"), SEQ ID NO:437 ("IGKJ2*01"), and SEQ ID NO:20 ("L2b"), respectively.

FIG. 24 shows sCAR-T cell constructs and sequences. FIG. 24A shows schematics of sCAR-T cell constructs. FIG. 24B shows an exemplary sCAR-T sequence. FIG. 24C shows the SEQ ID NOS of various components of sCAR-T cell constructs.

FIG. 25A shows expression of the sCAR on primary human T cells by flow cytometry binding to a labeled GCN4 peptide. FIG. 25B shows $EC_{50}$ of cytotoxicity with anti-CD19 switch against RS4;11. Constructs sorted to enrich CAR+ clones and expanded to 8-12 days prior to cytotoxicity. N=5-6. FIG. 25C and FIG. 25D show Table and scatter plot of $EC_{50}$'s by construct hinge, transmembrane domain and costimulatory domain (N=6 across three independent donors). Significance in FIG. 25D is by paired T test. FIG. 25E shows a NALM-6 xenograft model. Tumor burden was established by injecting NSG mice iv with $0.5 \times 10^6$ NALM-6 cells. Six days later, $20 \times 10^6$ sCAR-T or CART19 cells were injected, followed by 8 doses of switch (0.5 mg/kg) administered every other day. FIG. 25F shows cytokines measured from mouse serum, 24 h after the first dose of switch in the NALM-6 model, significance by one way ANOVA. FIG. 25G shows expansion of sCAR-T cells 24 h after the last dose of switch in the NALM-6 model. Significance by one way ANOVA. FIG. 25E, FIG. 25F, and FIG. 25G show cumulative data from three independent donors.

FIGS. 27A-27E show selection of the best humanized switchable CAR construct. FIG. 27A shows an alignment of murine, germline, and humanized light and heavy chain sequences. The 4 light chain sequences shown are SEQ ID NO:438 ("Murine"), SEQ ID NO:439 ("IGLV7-46*01"), SEQ ID NO:440 ("IGLJ2"), and SEQ ID NO:442 ("L5"), respectively. The 4 heavy chain sequences shown are SEQ ID NO:441 ("Murine"), SEQ ID NO:1 ("IGHV4-59*01"), SEQ ID NO:436 ("IGHJ4*01"), and SEQ ID NO:443 ("H4"), respectively. Blue square point mutations V12S, L109D, E6Q, and A87 and CDR 1, 2, and 3 for light and heavy chains. FIG. 27B shows long term (>50 days) antitumor efficacy across multiple in vivo assays comparing humanized CAR variants. Red lines indicate humanized variants with at least 1 mouse with <$10^4$ radiance at day 50. FIG. 27C upper box shows a schematic of light and heavy chain humanized variants. FIG. 27C lower portion shows humanized CAR group assignments corresponding to A-G plotted on FIGS. 27D and 27E. FIG. 27D shows in vitro dose-response cytotoxicity comparison across 41BB, CD28 and $3^{rd}$ Gen 28BB co-stimulatory domains of murine and humanized CAR variants in CD19+ RS411 cell line. FIG. 27E shows in vivo anti-tumor efficacy comparison across 41BB, CD28 and $3^{rd}$ Gen 28BB co-stimulatory domains of murine and humanized CAR variants in CD19+ Nalm6 xenograft models.

FIG. 28 shows alignment of murine (52SR4) and potential humanized sequences of heavy chain variable regions. Sequences shown in the figure are SEQ ID NO:1 ("4-59"), SEQ ID NO:444 ("52SR4"), SEQ ID NOs:2-4 ("h52SR4H1-h52SR4H3"), SEQ ID NO:445 ("h52SR4H3b"), and SEQ ID NO:446 ("h52SR4H2b").

FIG. 29 shows alignment of murine (52SR4) and potential humanized sequences of light chain variable regions. Sequences shown in the figure are SEQ ID NO:447 ("7-46" or "IGLV7-46"), SEQ ID NO:448 ("SP34"), SEQ ID NO:449 ("hum-VL5"), SEQ ID NO:450 ("52SR4"), and SEQ ID NOs:451-454 ("h52SR4L1-h52SR4L4").

FIG. 37A shows tumor progression in mice injected with 1:1 ratio of CD19+:CD19− Raji cells, and treated with anti-CD19 and anti-CD20 switches simultaneously. Additional 8 doses of anti-CD20 switch were administered every other day between days 64 and 78. N=3. FIG. 37B shows tumor progression in mice injected with 4:1 ratio of CD19+:CD19− Raji cells. Mice were treated with 8 doses of anti-CD20 switch every other day on days 10-24, and additional 8 doses of anti-CD20 switch were administered between days 64 and 78. N=3. FIG. 37C shows tumor progression in mice injected with 49:1 ratio of CD19+:CD19− Raji cells. Mice were treated with 8 doses of anti-CD20 switch every other day on days 18-32. N=3-6.

FIG. 38 shows a schematic depicting various constructs of murine sCARs constructed with different hinge lengths by utilizing the IgG4 short hinge, the mouse CD8 hinge, or mouse CD28 hinge.

FIG. 39A shows control of tumor growth by sCAR-T cells in immunocompetent mice: CAR efficacy comparison between IgG4 (SV-319-092) and mCD8 (SV-319-089) hinge. FIGS. 39B and 39C show cell kinetics in the peripheral blood (absolute numbers) through phenotyping by flow cytometry in 2 independent experiments: FIG. 39B shows CD45+ vs 4-1BB (SV-319-091)/28BB (SV-319-092) sCAR-T cells; and FIG. 39C shows B cells vs 28BB SV-319-092 sCAR-T cells. Tumor burden was established at day 0 by injecting C3H immunocompetent mice s.c. with 1×10⁶ 38C13 tumor cells. Seven days later, mice are preconditioned with 100 mg/kg cyclophosphamide (CTX) i.p. (tumors are measurable and mice are randomized). Twenty-four hours later, 10×10⁶ sCAR-T cells are injected i.v., followed by 8 doses of switch administered i.v. every other day over the period of 14 days at 1 mg/kg, starting 4 h after sCAR-T cell injection. After a 2-week resting period, switch dosing was resumed for another 8 doses at 1 mg/kg every other day at day 36 and at day 64. Immune cells from peripheral blood were analyzed at day 15, 25, 35, 53, 63, 81 and 99 post-tumor implantation (N=5/6). FIGS. 39D and 39E show the impact of different switch dosing regimens on sCAR-T cell expansion (FIG. 39D) and phenotype (FIG. 39E). Naïve C3H immunocompetent mice were preconditioned with 100 mg/kg cyclophosphamide (CTX) i.p. (day −1) and were injected i.v. 24 hours later with 10×10⁶ SV-319-092 sCAR-T cells followed by 4, 8 or 12 doses of switch administered i.v. every other day over the period of 6, 14 or 22 days at 0.2, 1 or 5 mg/kg, starting 4 h after sCAR-T cell injection. sCAR-T cell expansion and phenotype were monitored over time in the peripheral blood at day 7, 25, 35 and 53 after sCAR-T injection by flow cytometry (N=5).

DETAILED DESCRIPTION

Definitions

Figure 2A:
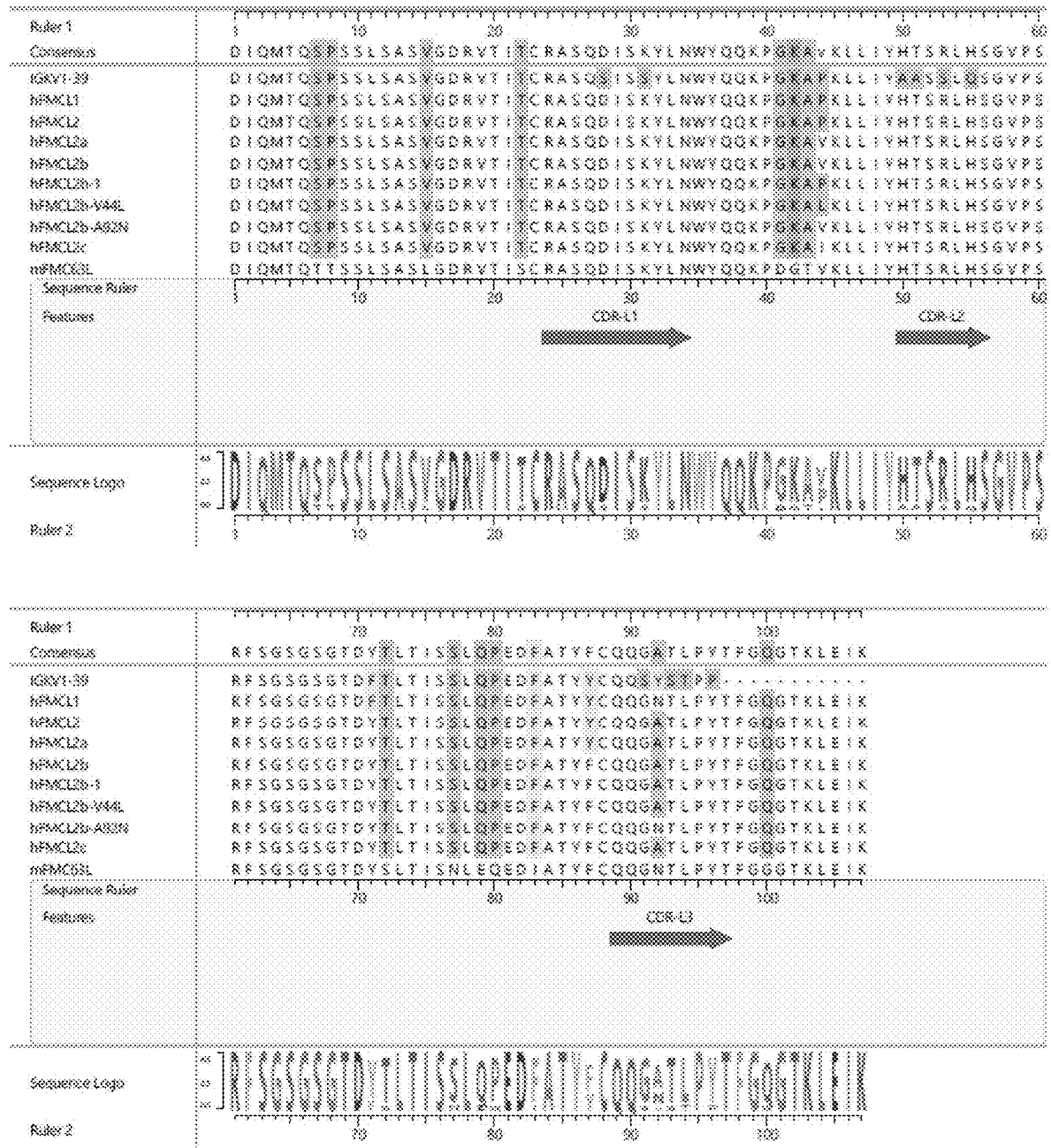

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, some potential and preferred methods and materials are now described. All publications mentioned herein are incorporated herein by reference to disclose and describe the methods and/or materials in connection with which the publications are cited. It is understood that the present disclosure supersedes any disclosure of an incorporated publication to the extent there is a contradiction (and in particular, any term definitions specifically set forth in the present application supersede any conflicting definition of that term disclosed in a publication incorporated by reference).

As will be apparent to those of skill in the art upon reading this disclosure, each of the individual embodiments described and illustrated herein has discrete components and features which may be readily separated from or combined with the features of any of the other several embodiments without departing from the scope or spirit of the present invention. Any recited method can be carried out in the order of events recited or in any other order which is logically possible.

It must be noted that as used herein and in the appended claims, the singular forms "a", "an", and "the" include plural referents unless the context clearly dictates otherwise. Thus, for example, reference to "a cell" includes a plurality of such cells and reference to "the peptide" includes reference to one or more peptides and equivalents thereof, e.g., polypeptides, known to those skilled in the art, and so forth.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

As used herein, the terms "antibody fragment" and "immunoglobulin fragment" are used interchangeably to refer to any form of an antibody other than the full-length form. Antibody fragments herein include antibodies that are smaller components that exist within full-length antibodies, and antibodies that have been engineered. Antibody fragments include, but are not limited to, Fv, Fc, Fab, and (Fab')2, single chain Fv (scFv), diabodies, triabodies, tetrabodies, bifunctional hybrid antibodies, a CDR1, a CDR2, a CDR3, combinations of CDRs, variable regions, framework regions, constant regions, heavy chains, light chains, alternative scaffold non-antibody molecules, and bispecific antibodies. Unless specifically noted otherwise, statements and claims that use the term "antibody" or "antibodies" may specifically include "antibody fragment" and "antibody fragments." The term "antigen binding fragment," used in reference to an antibody or an immunoglobulin means any antibody fragment that possesses binding affinity for a target (such as, e.g., a target protein, peptide, small molecule, tumor antigen). Antibody "fragment" and antibody "portion" are also used interchangeably herein, as are the terms "antigen binding fragment" and "antigen binding portion."

The term "anti-CD19 antibody" refers to an antibody that binds CD19. CD19, also known as "Cluster of Differentiation 19", is well-known in the art to be a protein that is expressed on the surface of B-cells.

The terms "chimeric receptor", "chimeric antigen receptor", and "CAR" are used interchangeably herein to refer to a receptor expressed on a suitable effector cell (e.g., a T cell), said receptor capable of binding to a CAR-ID, as described herein.

Reference to "CAR-EC" means "chimeric antigen receptor effector cell", and CAR-EC refers, generally, to an effector cell that expresses a chimeric receptor (such as, e.g., a chimeric antigen receptor). In some embodiments, CAR-EC is not limited, however, to merely effector cells expressing chimeric antigen receptors (i.e., expressing antibodies or antigen binding fragments of antibodies), but the term may also encompass effector cells expressing other chimeric receptors that are capable of binding to a target (e.g., a "chimeric antigen receptor-interacting domain" (CAR-ID) comprised on a CAR-EC switch, as disclosed herein. Suitable effector cells for use in the present invention (e.g., as CAR-ECs) include effector cells selected from a naive T cell, a memory stem cell T cell, a central memory T cell, an effector memory T cell, a helper T cell, a CD4+ T cell, a CD8+ T cell, a CD8/CD4+ T cell, an αβ T cell, a γδ T cell, a cytotoxic T cell, a natural killer T cell, a natural killer cell, a macrophage.

Reference to a CAR and its "complementary" CAR-EC switch (e.g., a complementary humanized anti-CD19 CAR-EC switch disclosed herein), or similarly reference to a CAR-EC switch and its "complementary CAR" means a pair of a CAR-EC switch comprising a particular CAR-ID, and a CAR that comprises an extracellular domain that comprises binding affinity for that particular CAR-ID. So, as a non-limiting example, one of average skill in the art will appreciate that a CAR-EC switch comprising a GCN4 peptide CAR-ID (e.g., with the amino acid sequence of SEQ ID NO: 26) will be bound by a CAR comprising an anti-GCN4 extracellular domain that has binding affinity for that GCN4 peptide (e.g., an anti-GCN4 antibody or antigen binding portion thereof such as a scFv). Thus, such an anti-GCN4 CAR and a CAR-EC comprising the GCN4 CAR-ID are "complementary" because the CAR binds the CAR-EC switch. Similarly, switches comprising a FITC, FLAG, K4, and E4 CAR-ID are complementary to CARs comprising binding affinity for FITC, FLAG, K4 (e.g., an E4 peptide), E4 (e.g., a K4 peptide), respectively.

The term "endotoxin-free" or "substantially endotoxin-free" relates generally to compositions, solvents, and/or vessels that contain at most trace amounts (e.g., amounts having no clinically adverse physiological effects to a subject) of endotoxin, and preferably undetectable amounts of endotoxin. Endotoxins are toxins associated with certain microorganisms, such as bacteria, typically gram-negative bacteria, although endotoxins may be found in gram-positive bacteria, such as *Listeria monocytogenes*. The most prevalent endotoxins are lipopolysaccharides (LPS) or lipo-oligo-saccharides (LOS) found in the outer membrane of various Gram-negative bacteria, and which represent a central pathogenic feature in the ability of these bacteria to cause disease. Small amounts of endotoxin in humans may produce fever, a lowering of the blood pressure, and activation of inflammation and coagulation, among other adverse physiological effects.

Therefore, in pharmaceutical production, it is often desirable to remove most or all traces of endotoxin from drug products and/or drug containers, because even small amounts may cause adverse effects in humans. A depyrogenation oven may be used for this purpose, as temperatures in excess of 300° C. are typically required to break down most endotoxins. For instance, based on primary packaging material such as syringes or vials, the combination of a glass temperature of 250° C. and a holding time of 30 minutes is often sufficient to achieve a 3 log reduction in endotoxin levels. Other methods of removing endotoxins are contemplated, including, for example, chromatography and filtration methods, as described herein and known in the art. Also included are methods of producing CAR-EC switches in and isolating them from eukaryotic cells such as mammalian cells to reduce, if not eliminate, the risk of endotoxins being present in a composition of the invention. Preferred are methods of producing CAR-EC switches in and isolating them from serum free cells.

Endotoxins can be detected using routine techniques known in the art. For example, the Limulus Ameobocyte Lysate assay, which utilizes blood from the horseshoe crab, is a very sensitive assay for detecting presence of endotoxin. In this test, very low levels of LPS can cause detectable coagulation of the limulus lysate due a powerful enzymatic cascade that amplifies this reaction. Endotoxins can also be quantitated by enzyme-linked immunosorbent assay (ELISA). To be substantially endotoxin-free, endotoxin levels may be less than about 0.001, 0.005, 0.01, 0.02, 0.03, 0.04, 0.05, 0.06, 0.08, 0.09, 0.1, 0.5, 1.0, 1.5, 2, 2.5, 3, 4, 5, 6, 7, 8, 9, or 10 EU/mg of protein. Typically, 1 ng lipopolysaccharide (LPS) corresponds to about 1-10 EU.

Reference to "FMC63" means the anti-CD19 mouse monoclonal antibody clone originally described in 1991 by H. Zola and coworkers (1), which has been used in the most well studied conventional CAR-T cell from Carl June and coworkers (2-4). These references (1, 2, 3, and 4, listed below in the "References" section) are incorporated herein by reference in their entirety. The terms "FMC63", "FMC", "huFMC", and "hFMC" are used interchangeably herein.

Reference to "FMC63 VH" means the variable portion of the heavy chain of the FMC63 antibody.

Reference to "FMC63 VL" means the variable portion of the light chain of the FMC63 antibody.

"Humanized" forms of non-human (e.g. murine) antibodies are chimeric immunoglobulins, immunoglobulin chains or fragments thereof (such as, e.g., Fv, Fab, (Fab')2, single chain Fv (scFv) or other antigen-binding subsequences of antibodies) in which the non-human (e.g., murine) framework regions of the variable domain are changed into human framework region sequences. In some embodiments, a humanized antibody is humanized to reduce immunogenicity to humans. In some embodiments, a humanized antibody retains the specificity and/or affinity of the parental non-human antibody. In some embodiments, a humanized antibody retains substantially all of the specificity and/or affinity of the parental non-human antibody.

As used herein, the term "or humanized variants thereof" refers to any sequence variant of a reference sequence, which variant comprises at least one amino acid change (i.e., substitution, deletion, or addition) that results in variant sequence having increased identity to a human germline sequence as compared to the reference sequence. In some embodiments, "or humanized variants thereof" refers to sequences that comprise at least one amino acid change that makes the sequence "more humanized", i.e., causes the sequence to have a greater identity with a human reference sequence. For example, a humanized variant of an FMC63 VH or FMC63 VL sequence is a sequence that comprises one or more (e.g., 2, 3, 4, 5, 6, 7, 8, 9, or more) mutations as compared to the murine parent FMC63VH and VL sequences provided as SEQ ID NOS: 15 and 25, respectively. In embodiments, the humanized variant of a reference antibody sequence or portion thereof (e.g., an FMC63 VH or FMC63 VL sequence) maintains binding affinity for the target of the reference antibody. For example, but not to be limited in any way, a humanized FMC63 sequence may maintain binding to CD19.

The term "humanized anti-CD19 switch" refers, generally, to any CAR-EC switch that comprises a targeting moiety that (i) is capable of binding CD19; and (ii) is a humanized variant of a reference CD19 antibody. In some embodiments, the humanized anti-CD19 switch comprises a humanized form of the reference antibody FMC63. In some embodiments, the humanized anti-CD19 switch comprises a humanized portion of the reference antibody FMC63 (e.g., (i) a humanized FMC63 VH, (ii) a humanized FMC63 VL, or (iii) a humanized FMC63 VH and a humanized FMC63 VL.

The term "humanized switch" refers, generally, to any CAR-EC switch that comprises a targeting moiety that (i) is capable of binding a target; and (ii) is a humanized variant of a reference antibody or an antigen binding portion thereof. In some embodiments, the humanized switch comprises a humanized form of the reference antibody. In some embodiments, the humanized switch comprises a humanized portion of the reference antibody (e.g., (i) a humanized VH, (ii) a humanized VL, or (iii) a humanized VH and a humanized VL.

By a subject polypeptide sequence having an amino acid sequence at least, for example, 95% "identical" to a query amino acid sequence disclosed herein, it is intended that the amino acid sequence of the subject polypeptide is identical to the query sequence except that the subject polypeptide sequence may include up to five amino acid alterations per each 100 amino acids of the query amino acid sequence. In other words, to obtain a subject polypeptide having an amino acid sequence at least 95% identical to a query amino acid sequence, up to 5% of the amino acid residues in the subject sequence may be inserted, deleted, or substituted with another amino acid. These alterations as compared to the reference sequence may occur at the amino- or carboxy-terminal positions of the reference amino acid sequence or anywhere between those terminal positions, interspersed either individually among residues in the reference sequence or in one or more contiguous groups within the reference sequence. The identity of two or more sequences (e.g., amino acid sequences) can be compared to one another, or to published sequences, using the Basic Local Alignment Search Tool or "BLAST" algorithm; described in Johnson M, et al., (2008) NCBI BLAST: a better web interface. Nucleic Acids Res. 36:W5-W9 (incorporated herein by reference in its entirety). Similarly, identity can be determined between two nucleotide sequences in the same manner. Thus, to obtain a subject nucleotide sequence (e.g., RNA or DNA sequence, such as a cDNA sequence) that is at least 95% identical to a query nucleotide sequence, up to 5% of the nucleotide residues in the subject sequence may be inserted, deleted, or substituted with another nucleotide.

The terms "switch" and "CAR-EC Switch" are used interchangeably herein.

Reference to "VH" means the variable portion of a heavy chain of an antibody or an antibody fragment.

Reference to "VL" means the variable portion of the light chain of an antibody or an antibody fragment.

Reference to an antibody, or antigen binding portion thereof that is said to "specifically bind" or "preferentially bind" (used interchangeably herein) to a polypeptide or other target (e.g., to CD19) is a term well understood in the art, and methods to determine such specific or preferential binding are also well known in the art. A molecule is said to exhibit "specific binding" or "preferential binding" if it reacts or associates more frequently, more rapidly, with greater duration and/or with greater affinity with a particular cell or substance than it does with alternative cells or substances. An antibody "specifically binds" or "preferentially binds" to a target if it binds with greater affinity, avidity, more readily, and/or with greater duration than it binds to other substances. For example, an antibody that specifically or preferentially binds to CD19 is an antibody that binds CD19 with greater affinity, avidity, more readily, and/or with greater duration than it binds to other non-CD19 polypeptides. It is also understood by reading this definition that, for example, an antibody (or an antigen binding portion thereof) that specifically or preferentially binds to a first target (e.g., CD19) may or may not specifically or preferentially bind to a second target. As such, "specific binding" or "preferential binding" does not necessarily require (although it can include) exclusive binding. Generally, but not necessarily, reference to binding means preferential binding.

"Substantially" or "essentially" means of ample or considerable amount, quantity, size; nearly totally or completely; for instance, 95% or greater of some given quantity.

"Substantially similar" sequences are sequences comprising at least about 90% identity in sequence (e.g., amino acid or nucleotide sequence) with one another, or at least about 95%, 96%, 97%, 98%, 99% or more than about 99% identity with one another.

Overview:

Disclosed herein are compositions and methods for selectively activating and deactivating chimeric receptor effector cells (e.g., chimeric antigen receptor T cells), which may provide for a safer and more versatile immunotherapy than conventional CAR-T cell designs currently being tested in clinical trials by providing control over the therapy.

Disclosed herein are switchable chimeric receptor effector cells (CAR-ECs) and chimeric receptor effector cell switches (referred to as "switches," herein), including humanized switches and humanized CAR-ECs.

Disclosed herein are platforms comprising one or more switch disclosed herein (e.g., a humanized switch) and one or more CAR-ECs (e.g., a CAR-EC disclosed here, such as a humanized CAR-EC), wherein a CAR expressed on a CAR-EC included in the platform is complementary to a switch included in the platform. In some embodiments, the platforms comprise a plurality of switches, each of which bind different targets (i.e., each switch has a different targeting moiety) and each of which are complementary to a single CAR-EC included in the platform. In some embodiments, the platforms comprise a plurality of switches, each of which bind different targets (i.e., each switch has a different targeting moiety) and each of which are complementary to at least one of a plurality of CAR-ECs included in the platform.

The switches disclosed herein comprise a first region that is bound by an effector cell chimeric receptor and a second region that binds a cell surface molecule on target cell. The first region is referred herein as a chimeric antigen receptor interacting domain (CAR-ID). The second region is referred to herein as a "targeting moiety." The targeting moiety may be a targeting polypeptide. The targeting polypeptide may be a targeting antibody or antibody fragment that binds an antigen on the target cell. The targeting antibody or antigen binding portion thereof may be humanized. The humanized switches disclosed herein may comprise a targeting moiety that is humanized. In some embodiments, the cell surface molecule is CD19. In some embodiments, the cell surface molecule is Her2, CLL1, CD33, CD123, EGFR, EGFRvIII, CD20, CD22, CS1, BCMA, CEA or a fragment thereof. In some embodiments, the targeting moiety binds CD19. In some embodiments, the targeting moiety binds Her2, CLL1, CD33, CD123, EGFR, EGFRvIII, CD20, CD22, CS1, BCMA, CEA or a fragment thereof. In some particular embodiments, the targeting moiety specifically binds CD19. In some particular embodiments, the targeting moiety specifically binds Her2, CLL1, CD33, CD123, EGFR, EGFRvIII, CD20, CD22, CS1, BCMA, CEA or a fragment thereof. In some particular embodiments, the targeting moiety is an anti-CD19 antibody, or an antigen binding portion thereof. In some embodiments, the targeting moiety comprises or consists of a humanized anti-CD19 antibody, or an antigen binding portion thereof (e.g., any one or more of the humanized anti-CD19 antibodies or antigen binding portions thereof disclosed herein). In some embodiments, the targeting moiety comprises or consists of a humanized FMC63 antibody, or an antigen binding portion thereof.

Figure 14:
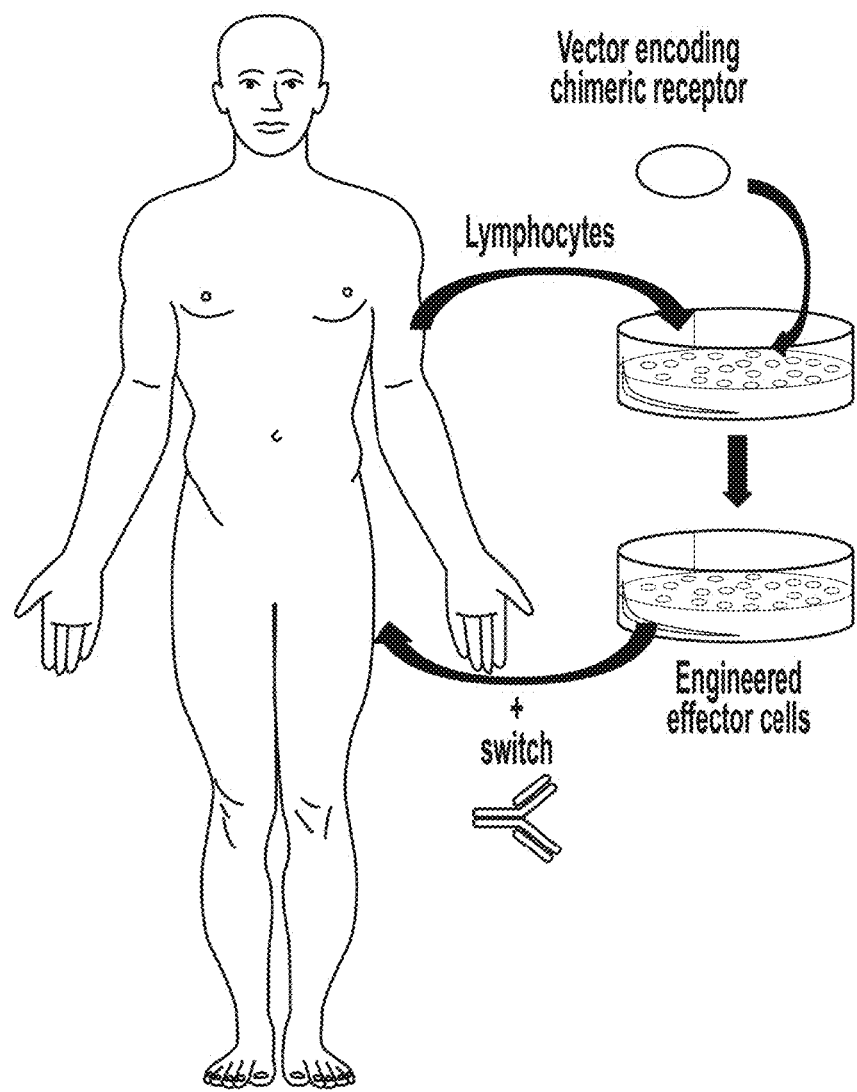
FIG. 14: shows a general overview of switchable chimeric receptor-T cell therapy disclosed herein. Lymphocytes are isolated from a subject and an expression vector encoding a chimeric receptor is subsequently introduced to the lymphocytes to produce chimeric receptor effector cells. Chimeric receptor effector cells are administered to the subject, along with a switch.

Chimeric receptor binding of the switch may stimulate an immune response from the effector cell that is cytotoxic to the bound target cell. In some embodiments, the effector cell is a T cell. The switch may act as an "on-switch," triggering (or increasing) effector cell activation. The switch may act as an "off switch," blocking (or decreasing) effector cell activation. Effector cell activity may be "turned off" by reducing or ceasing administration of the switch. The humanized switches disclosed herein may be used with the effector cells disclosed herein, as well as existing CAR T-cells, for the treatment of a disease or condition, such as cancer, wherein the target cell is a malignant cell. Such treatment may be referred to herein as switchable immunotherapy, for which an exemplary schematic overview is depicted in FIG. 14.

Methods, kits and compositions are provided for producing CAR-EC cells, CAR-EC platforms and humanized CAR-EC switches, which are used to bring an effector cell together with a target (e.g., a target cell such as a tumor) in a subject. These methods, kits and compositions find therapeutic use in a number of diseases and conditions. For example, methods, kits, and compositions comprising a CAR-EC switch with an anti-CD19 targeting moiety may be used to treat any disease in which CD19$^+$ cells are implicated in pathology. For example, but not to be limited in any way, in some embodiments, heterogeneous tumors and blood cell malignancies (e.g., acute lymphoblastic leukemia and chronic lymphocytic leukemia) may be effectively treated with a CAR-EC cell, CAR-EC switch, and/or a CAR-EC platform disclosed herein. In some non-limiting embodiments, CAR-EC cells, CAR-EC platforms and/or humanized CAR-EC switches may be used to treat, e.g., a disease selected from multiple myeloma, acute myeloid leukemia, Hodgkins lymphoma, Non-hodgkins lymphoma (NHL), Diffuse large B cell lymphoma (DLBCL), Follicular lymphomas, Mantle cell lymphoma (MCL), Burkitt lymphoma, and Hairy cell leukemia (HCL).

Similarly, methods, kits, and compositions comprising a CAR-EC switch with an anti-Her2 targeting moiety may be used to treat any disease in which Her2$^+$ cells are implicated in pathology; methods, kits, and compositions comprising a CAR-EC switch with an anti-CLL1 targeting moiety may be used to treat any disease in which CLL1$^+$ cells are implicated in pathology, and similarly, methods, kits, and compositions comprising a CAR-EC switch with any targeting moiety that has specificity for a particular target antigen (e.g., a tumor antigen) may be used to treat any disease in which that target antigen (e.g., tumor antigen) is implicated in pathology.

In some embodiments, the length, valency and/or orientation of the CAR-EC switch linkage as well as the CAR-EC switch cell targeting moiety is optimized. Heterogeneous tumors may be more effectively treated with multiple switches that target more than one tumor antigens. Advantages and features of the invention will become apparent to those persons skilled in the art upon reading the details of the compositions and methods as more fully described below.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

I. CAR-EC Switches

Disclosed herein are chimeric receptor-effector cell switches comprising: (i) a first region (CAR-ID) that is capable of being bound by a chimeric receptor on an effector cell (e.g., a chimeric antigen receptor) and (ii) a second region (targeting moiety) that binds a cell surface molecule on a target cell.

In some embodiments, the present disclosure provides a chimeric receptor-effector cell switch comprising: (i) a first region (CAR-ID) that comprises a yeast transcription factor GCN4 peptide derivative (e.g., a GCN4 peptide derivative selected from SEQ ID NOS: 139, 154-163) and (ii) a second region (targeting moiety) that binds a cell surface molecule on a target cell; wherein the CAR-ID is capable of being bound by a chimeric receptor on an effector cell (e.g., a chimeric antigen receptor).

In some embodiments, the present disclosure provides a humanized chimeric receptor-effector cell switch comprising: (i) a first region (CAR-ID) that is capable of being bound by a chimeric receptor on an effector cell (e.g., a chimeric antigen receptor) and (ii) a second region (targeting moiety) that binds a cell surface molecule on a target cell; wherein the targeting moiety is humanized.

In some particular embodiments, the present disclosure provides a humanized chimeric receptor-effector cell switch comprising: (i) a first region (CAR-ID) that is capable of being bound by a chimeric receptor on an effector cell (e.g., a chimeric antigen receptor) and (ii) a second region (targeting moiety) that binds CD19 on a target cell; wherein the targeting moiety is humanized.

In some particular embodiments, the present disclosure provides a humanized chimeric receptor-effector cell switch comprising: (i) a first region (CAR-ID) that comprises a yeast transcription factor GCN4 peptide derivative (e.g., a GCN4 peptide derivative selected from SEQ ID NOS: 139, 154-163) and (ii) a second region (targeting moiety) that binds CD19 on a target cell; wherein the targeting moiety is humanized.

In some embodiments, the first and second regions are linked by a linker.

In some embodiments, the first region and the second region are fused together. As used herein, the term "fused" may refer to adjoining a terminus of the CAR-ID with a terminus of a polypeptide targeting moiety (e.g., a humanized anti-CD19 antibody or an antigen binding fragment thereof). In some embodiments, the first region and the second region are fused together via a linker.

In some embodiments, the first region is grafted into the second region. As used herein, the term "grafted" may refer to inserting a CAR-ID within a targeting polypeptide (e.g., between two amino acids of the targeting polypeptide). In some embodiments, the second region is grafted into the first region. In some embodiments, the first region is grafted into the second region such that the first and the second regions are linked by at least one linker. In some embodiments, the second region is grafted into the first region such that the first and the second regions are linked by at least one linker.

In some embodiments, the first region is attached to the second region. In some embodiments, the first region is attached to the second region via a linker. The linker may be attached to a CAR-ID. The linker may be attached to a targeting moiety. The linker may attach a CAR-ID to a targeting moiety. The one or more linkers may attach the one or more CAR-IDs to the one or more targeting moieties. The one or more linkers may attach the one or more CAR-IDs to the one or more targeting moieties in a site-specific manner. Attachment in a site-specific manner may comprise attaching the one or more CAR-IDs to a predetermined site on the one or more targeting moieties. Alternatively, or additionally, attachment in a site-specific manner may comprise attaching the one or more CAR-IDs to an unnatural amino acid in the one or more targeting moieties. The one or more linkers may attach the one or more CAR-IDs to the one or more targeting moieties in a site-independent manner. Attachment in a site-independent manner may comprise attaching the one or more CAR-IDs to a random site on the one or more targeting moieties. The CAR-ID may be attached to 1, 2, 3, 4, 5 or more targeting moieties in a site-specific manner. The CAR-ID may be attached to 1, 2, 3, 4, 5 or more targeting moieties in a site-independent manner. Alternatively, the targeting moiety may be attached to 1, 2, 3, 4, 5 or more CAR-IDs in a site-specific manner. Attachment in a site-specific manner may comprise attaching the one or more targeting moieties to a predetermined site on the one or more CAR-IDs. The targeting moiety may be attached to 1, 2, 3, 4, 5 or more CAR-IDs in a site-independent manner. Attachment in a site-independent manner may comprise attaching the one or more targeting moieties to a random site on the one or more CAR-IDs.

The CAR-EC switch may have any switch sequence disclosed herein. For example, it may comprise a light chain and a heavy chain, wherein the light chain comprises or consists of any switch light chain sequence disclosed herein and the heavy chain comprises or consists of any switch heavy chain sequence disclosed herein. Such heavy and/or light chain sequences may be humanized. In some embodiments, the CAR-EC switch is humanized and comprises a light chain sequence selected from SEQ ID NOS: 17-24 and a heavy chain sequence selected from SEQ ID NOS: 2-14, wherein one or both of the heavy and light chains comprise a CAR-ID disclosed herein (e.g., a GCN4 CAR-ID). In some embodiments, the CAR-EC switch is humanized and comprises a light chain sequence that is at least 80%, 85%, 80%, 95%, 96%, 97%, 98%, or at least 99% identical to a sequence selected from SEQ ID NOS: 17-24 and a heavy chain sequence that is at least 80%, 85%, 80%, 95%, 96%, 97%, 98%, or at least 99% identical to a sequence selected from SEQ ID NOS: 2-14, wherein one or both of the heavy and light chains comprise a CAR-ID disclosed herein (e.g., a GCN4 CAR-ID). In particular embodiments, the light chain sequence comprises a humanized sequence selected from SEQ ID NOS: 27-34 (which comprise an N-terminal GCN4 CAR-ID) and a heavy chain sequence selected from SEQ ID NOS: 2-14. In particular embodiments, the light chain sequence comprises a humanized sequence that is at least 80%, 85%, 80%, 95%, 96%, 97%, 98%, or at least 99% identical to a sequence selected from SEQ ID NOS: 27-34 (which comprise an N-terminal GCN4 CAR-ID) and a heavy chain sequence that is at least 80%, 85%, 80%, 95%, 96%, 97%, 98%, or at least 99% identical to a sequence selected from SEQ ID NOS: 2-14. In particular embodiments, the switch is a switch described in Table 6 or Table 8, which presents heavy chain/light chain combinations comprised in several of the switches disclosed herein. In some embodiments, the switch is identical to a switch described in Table 6 or Table 8, except that the CAR-ID comprised in the switch is modified to have a sequence of Structure I. In some embodiments, the sequence of Structure I is selected from any one of SEQ ID NOS: 26, 36, 139, and 154-163. In certain particular embodiments, the CAR-EC switch comprises the L2b-LCNT (SEQ ID NO: 30) light chain and the H4c (SEQ ID NO: 7) heavy chain.

In certain particular embodiments, the CAR-EC switch comprises (i) a sequence that is at least 80%, 85%, 80%, 95%, 96%, 97%, 98%, or at least 99% identical to the L2b-LCNT (SEQ ID NO: 30) light chain and (ii) a sequence that is at least 80%, 85%, 80%, 95%, 96%, 97%, 98%, or at least 99% identical to the H4c (SEQ ID NO: 7) heavy chain.

In certain particular embodiments, the CAR-EC switch comprises the L2b-LCNT (SEQ ID NO: 30) light chain and the H4b (SEQ ID NO: 6) heavy chain. In certain particular embodiments, the CAR-EC switch comprises (i) a sequence that is at least 80%, 85%, 80%, 95%, 96%, 97%, 98%, or at least 99% identical to the L2b-LCNT (SEQ ID NO: 30) light chain and (ii) a sequence that is at least 80%, 85%, 80%, 95%, 96%, 97%, 98%, or at least 99% identical to the H4b (SEQ ID NO: 6) heavy chain.

In certain particular embodiments, the CAR-EC switch comprises (i) a sequence that is at least 80%, 85%, 80%, 95%, 96%, 97%, 98%, or at least 99% identical to the L2c-LCNT (SEQ ID NO: 34) light chain and (ii) a sequence that is at least 80%, 85%, 80%, 95%, 96%, 97%, 98%, or at least 99% identical to the H4b (SEQ ID NO:6) heavy chain.

In certain particular embodiments, the CAR-EC switch comprises (i) a sequence that is at least 80%, 85%, 80%, 95%, 96%, 97%, 98%, or at least 99% identical to the L2c-LCNT (SEQ ID NO: 34) light chain and (i) a sequence that is at least 80%, 85%, 80%, 95%, 96%, 97%, 98%, or at least 99% identical to the H4c (SEQ ID NO:7) heavy chain.

In some embodiments, the present disclosure provides a CAR-EC switch that comprises or consists of a sequence that is identical to any one switch disclosed in any one of the following applications: PCT/US2014/060713, PCT/US2014/060684, PCT/US2016/024524, PCT/US2016/027997, and PCT/US2016/027990 (each of which are incorporated herein by reference in its entirety), except that the switch comprises a humanized antibody as its targeting moiety or the switch comprises an antigen-binding portion of a humanized antibody as its targeting moiety. In some particular embodiments, the present disclosure provides a CAR-EC switch that comprises or consists of a sequence that is identical to any one switch disclosed in any one of the following applications: PCT/US2014/060713, PCT/US2014/060684, PCT/US2016/024524, PCT/US2016/027997, and PCT/US2016/027990 (each of which are incorporated herein by reference in its entirety), except that the switch comprises a humanized FMC63 antibody disclosed herein as its targeting moiety or the switch comprises an antigen-binding portion of a humanized FMC63 antibody as its targeting moiety. Thus, in some embodiments, the present disclosure provides a switch comprising a humanized FMC63 antibody or an antigen binding portion thereof linked or fused to any one of the CAR-IDs disclosed in any one of the applications: PCT/US2014/060713, PCT/US2014/060684, PCT/US2016/024524, PCT/US2016/027997, and PCT/US2016/027990. It will be apparent to one skilled in the art that PCT/US2014/060684 and PCT/US2016/027997 refer to CAR-IDs as "CAR-BPs", and any such CAR-BP is suitable as a CAR-ID for use in the present invention. Similarly, PCT/US2016/024524 refers to CAR-IDs as "chimeric receptor binding partners" and any such chimeric receptor binding partner is suitable as a CAR-ID for use in the present invention. PCT/US2016/027990 refers to CAR-IDs as CAR-IDs, and any such CAR-ID disclosed in PCT/US2016/027990 is suitable for use as a CAR-ID in the present invention. Further, the application provides a chimeric receptor that is able to bind to the CAR-ID on the switch and an effector cell expressing such a chimeric receptor. Thus, accordingly, any of the chimeric receptors (e.g., CARs) disclosed in any one of the applications: PCT/US2014/060713, PCT/US2014/060684, PCT/US2016/024524, PCT/US2016/027997, and PCT/US2016/027990 may be used according to the present invention in combination with a CAR-EC switch disclosed herein. In some embodiments, the present disclosure provides a method of treating a patient in need of such treatment with a CAR-EC switch disclosed herein and a CAR disclosed in any one of the applications: PCT/US2014/060713, PCT/US2014/060684, PCT/US2016/024524, PCT/US2016/027997, and PCT/US2016/027990.

First Region of the CAR-EC Switch: CAR-Interaction Domains.

The CAR-Interaction Domains (CAR-ID) comprised on the humanized CAR-EC switches disclosed herein may be anything that may be fused, conjugated, or otherwise attached to a targeting moiety described herein (e.g., a humanized anti-CD19 antibody or an antigen binding portion thereof), such that the CAR-ID is capable of being bound by a chimeric receptor (e.g., a CAR) on an effector cell (e.g., a T cell). For example, in non-limiting embodiments, the CAR-ID may be a chimeric receptor binding protein (e.g., a CAR-binding protein). In non-limiting embodiments, the CAR-ID may be a chimeric receptor binding peptide (e.g., a CAR-binding peptide). In non-limiting embodiments, the CAR-ID may be a chimeric receptor binding small molecule (e.g., a CAR-binding small molecule). In some embodiments, binding of the CAR to the CAR-ID on a switch activates the CAR. In some embodiments, binding of the CAR to the CAR-ID on a switch activates the CAR only if the targeting moiety on the switch is also concurrently bound to its target. In some embodiments, binding of a CAR to the CAR-ID on a switch activates the CAR only if a humanized anti-CD19 antibody on the switch (e.g., any one of the humanized anti-CD19 antibodies disclosed herein) is also concurrently bound to CD19 on a target cell. In such embodiments, the CAR may be expressed on an effector cell. In such embodiments, the binding of the CAR expressed on an effector cell to the CAR-ID on the switch while a humanized anti-CD19 antibody on the switch (e.g., any one of the humanized anti-CD19 antibodies disclosed herein) is also concurrently bound to CD19 on a target cell results in target cell cytotoxicity.

Chimeric Receptor Binding Proteins

In some embodiments, the CAR-ID comprises or consists of a chimeric receptor binding protein that is bound by a chimeric receptor. The chimeric receptor binding protein may have high proteolytic stability and low immunogenicity in humans relative to a protein in general. The chimeric receptor binding protein may comprise a foreign protein or portion thereof. The chimeric receptor binding protein may not comprise a foreign protein or portion thereof. The chimeric receptor binding protein may be selected from a hormone, a cytokine, a chemokine, a growth factor, a cell adhesion molecule, a signaling peptide, a receptor, a cell surface peptide and fragments thereof. The chimeric receptor binding protein may be a ligand or a fragment thereof. The ligand may be a hormonal ligand. The chimeric receptor binding protein may have a length of more than about 100 amino acids, more than about 200 amino acids, more than about 300 amino acids, more than about 400 amino acids, more than about 500 amino acids, more than about 600 amino acids, more than about 700 amino acids, more than about 800 amino acids, more than about 900 amino acids, or more than about 1000 amino acids. The chimeric receptor binding protein may have a length of about 100 amino acids, about 200 amino acids, about 300 amino acids, about 400 amino acids, about 500 amino acids, about 600 amino acids, about 700 amino acids, about 800 amino acids, about 900 amino acids, or about 1000 amino acids. The chimeric receptor binding protein may be an antigen.

The chimeric receptor binding protein may comprise an antibody or antibody fragment. The chimeric receptor binding protein may not comprise an antibody or antibody fragment. The chimeric receptor binding protein may comprise at least about 100, at least about 200, at least about 300, at least about 400, or at least about 500 amino acids of an antibody or antibody fragment. The antibody or antibody fragment may comprise a variable domain or portion thereof. The antibody or antibody fragment may comprise a constant domain or portion thereof.

The chimeric receptor binding protein may comprise a non-naturally occurring protein. The chimeric receptor binding protein may comprise a synthetic protein. The chimeric receptor binding protein may comprise a non-animal protein (e.g., a protein not expressed in an animal). The chimeric receptor binding protein may comprise a non-mammalian protein. The chimeric receptor binding protein may comprise a non-human protein. The chimeric receptor binding protein may comprise a protein derived from any live being from any of the six kingdoms (Animalia, Plantae, Fungi, Protista, Archaea/Archaeabacteria, and Bacteria/Eubacteria), viruses, and prions.

The chimeric receptor binding protein may comprise a protease cleavage site. Any protease cleavage site known in the art may be comprised in the chimeric receptor binding protein. The protease cleavage site may be recognized by, e.g., thrombin, factor Xa, TEV protease, Human Rhinovirus 3C protease (HRV3C), ubiquitin-like-specific protease 1 (Ulp1), a matrix metalloprotease (MMP) or enterokinase. The MMP may be MMP8. The MMP may be MMP9.

The chimeric receptor binding protein may be based on or derived from a naturally occurring protein. The peptide may be based on or derived from a human protein. The chimeric receptor binding protein may be based on or derived from a protein expressed in animal selected from a chimpanzee, a monkey, a rat, a mouse, a bird, a fish, a pig, a horse, a cow, a goat, a chicken, a rabbit and a guinea pig. The chimeric receptor binding protein may be based on or derived from a mammalian protein. The chimeric receptor binding protein may be based on or derived from a non-mammalian protein. The chimeric receptor binding protein may be based on or derived from a protein expressed in a plant. The chimeric receptor binding protein may be based on or derived from a prokaryotic protein. The chimeric receptor binding protein may be based on or derived from a eukaryotic protein. The chimeric receptor binding protein may be based on or derived from a protein expressed by a yeast.

Thus, in various non-limiting embodiments, the chimeric receptor binding protein may comprise an enzyme. The enzyme may be a nuclease. The nuclease may be a ribonuclease. The ribonuclease may be prokaryotic. The chimeric receptor binding protein may comprise a substrate. The chimeric receptor binding protein may comprise barstar. The chimeric receptor binding protein may comprise barnase. In some embodiments, the chimeric receptor binding protein may be a protein selected from a fibrous protein, an adhesion molecule protein, and a membrane protein. The chimeric receptor binding protein may comprise a *Streptococcus pyogenes* pilin protein. The chimeric receptor binding protein may comprise a *Streptococcus pyogenes* fibronectin binding protein (SpyCatcher). The chimeric receptor binding protein may comprise a protein or a portion of a protein selected from a synaptobrevin, a SNAP25 and a syntaxin, and portions thereof (e.g., alpha helix). The chimeric receptor binding protein may comprise an RNAseI. The chimeric receptor binding protein may comprise a HuS adapter protein.

Chimeric Receptor Binding Peptide

In some embodiments, the CAR-ID comprises or consists of a peptide, e.g., a CAR binding peptide. The CAR-ID may be a peptide that is capable of being bound by a chimeric antigen receptor (CAR). The CAR-ID may be, e.g., any "peptidic antigen," "peptide neo-epitope (PNE)," or "chimeric antigen binding peptidic antigen (CAR-BP)" disclosed in PCT/US2014/060684 or PCT/US2016/027997, each of which are incorporated herein by reference in their entirety.

The CAR-ID may have high proteolytic stability and low immunogenicity in humans relative to peptides in general. The CAR-ID may be selected from a hormone, a cytokine, a chemokine, a growth factor, a cell adhesion molecule, a signaling peptide, a receptor, a cell surface peptide and fragments thereof. The CAR-ID may be a peptoid. The CAR-ID may be a peptide nucleic acid (PNA). The CAR-ID may be a ligand or a fragment thereof. The ligand may be a hormonal ligand. The ligand may be a peptide ligand. The CAR-ID may be a cyclic peptide. The CAR-ID may be a linear peptide.

The CAR-ID may have a length of between about 2 and about 10, about 10 and about 20, about 20 and about 30, about 30 and about 40, about 40 and about 50, about 50 and about 60, about 60 and about 70, about 70 and about 80, and about 80 and about 90 amino acids. The CAR-ID may be an antigen. The CAR-ID may be an epitope. The CAR-ID may be a nonlinear epitope. The CAR-ID may further comprise a second peptide.

The CAR-ID may not comprise an antibody or antibody fragment. The CAR-ID may comprise less than 10 amino acids of an antibody or antibody fragment. The CAR-ID may comprise less than 12 amino acids of an antibody or antibody fragment. The CAR-ID may comprise less than 15 amino acids of an antibody or antibody fragment. The CAR-ID may comprise less than 20 amino acids of an antibody or antibody fragment. The CAR-ID may comprise less than 22 amino acids of an antibody or antibody fragment. The CAR-ID may comprise less than 30 amino acids of an antibody or antibody fragment. The CAR-ID may not comprise a paratope of an antibody or antibody fragment.

The CAR-ID may comprise a non-naturally occurring peptide. The CAR-ID may comprise a synthetic peptide. The CAR-ID may comprise a non-animal peptide (e.g., a peptide not expressed in an animal). The CAR-ID may comprise a non-mammalian peptide. The CAR-ID may comprise a non-human peptide. The peptide may be derived from any live being from any of the six kingdoms (Animalia, Plantae, Fungi, Protista, Archaea/Archaeabacteria, and Bacteria/Eubacteria), viruses, and prions. Thus, the peptide may be derived from, consist of, or comprise a human, mammal, non-mammal, plant, a yeast, a bacteria, a reptile, a bird an insect, a eukaryote, or a prokaryote. The term "a peptide derived from" a particular biological organism (e.g., mammal, yeast, etc.) is meant to describe a peptide that comprises a sequence that is substantially similar to a sequence of a native peptide known to exist in such a biological organism, except that the sequence has been modified, i.e., to include one or more addition, deletion, insertion, or substitution of an amino acid. In some embodiments, the sequence is modified by humanization, e.g., to reduce immunogenicity of the peptide to humans. In some embodiments, the peptide derived from a biological organism (e.g., a eukaryote, prokaryote, mammal, human, yeast, etc.) comprises a non-natural sequence that is at least about 80% identical to a peptide that is native to that biological organism, or at least about 85%, 90%, 95%, 96%, 97%, 98%, 99%, or greater than 99% identical to a peptide that is native to that biological organism.

The CAR-ID may comprise a myc-tag. The CAR-ID may comprise His-tag. The CAR-ID may comprise an HA-tag. The CAR-ID may comprise peridinin chlorophyll protein complex. The CAR-ID may comprise green fluorescent protein (GFP). The CAR-ID may comprise red fluorescent protein (RFP). The CAR-ID may comprise phycoerythrin (PE). The CAR-ID may comprise streptavidin. The CAR-ID may comprise avidin. The CAR-ID may comprise horseradish peroxidase (HRP). The CAR-ID may comprise alkaline phosphatase. The CAR-ID may comprise glucose oxidase. The CAR-ID may comprise glutathione-S-transferase (GST). The CAR-ID may comprise maltose binding protein. The CAR-ID, by non-limiting example, may be a c-myc tag, polyhistidine tag, V5, VSVG, softag 1, softag 3, express tag, S tag, palmitoylation, nitrosylation, SUMO tag, thioredoxin, poly(NANP), poly-Arg, calmodulin binding protein, PurF fragment, ketosteroid isomerase, PaP3.30, TAF12 histone fold domain, FKBP-tag, SNAP tag, Halo-tag, peptides from RNAse I. The CAR-ID may comprise a protease cleavage site. The protease cleavage site may be recognized by thrombin, factor Xa, TEV protease or enterokinase.

The CAR-ID may be a small linear hydrophilic peptide. The small linear hydrophilic peptide may comprise a linker. The small linear hydrophilic peptide may be a hydrophilic target peptide (HTP). The small linear hydrophilic peptide may comprise the sequence GGGGSDYKDDDDK (SEQ ID NO. 38). The small linear hydrophilic peptide may comprise the sequence GGGGSDYKDDDDKP (SEQ ID NO: 39). The small linear hydrophilic peptide may consist essentially of the sequence GGGGSDYKDDDDK (SEQ ID NO:38). The small linear hydrophilic peptide may consist essentially of the sequence GGGGSDYKDDDDKP (SEQ ID NO: 39). The small linear hydrophilic peptide may be at least about 50% identical to SEQ ID NOs: 38 or 39. The small linear hydrophilic peptide may be at least about 60% identical to SEQ ID NOS: 38 or 39. The small linear hydrophilic peptide may be at least about 70% identical to SEQ ID NOS: 38 or 39. The small linear hydrophilic peptide may be at least about 80% identical to SEQ ID NOS: 38 or 39. The small linear hydrophilic peptide may be at least about 85% identical to SEQ ID NOS: 38 or 39. The small linear hydrophilic peptide may be at least about 90% identical to SEQ ID NOS: 38 or 39. The small linear hydrophilic peptide may have reduced non-specific binding relative to other peptides known in the art. The small linear hydrophilic peptide may have reduced non-specific binding and reduced fusion protein instability relative to other peptides disclosed herein. The CAR-ID may comprise a FLAG® tag (DYKDDDDK SEQ ID NO: 40) or a derivative or a homolog thereof.

The CAR-ID may be based on or derived from a naturally occurring peptide. The peptide may be based on or derived from a human peptide. The CAR-ID may be a non-endogenous peptide or a non-native peptide, as opposed to an endogenous peptide or native peptide. An endogenous peptide may be something that is naturally or normally present in the human body (e.g., biotin, Fc of monoclonal antibody) or that the human body typically encounters. Thus, a non-endogenous peptide would be something foreign or not naturally present in the human body. For example, switches disclosed herein may employ GCN4 peptides as CAR-IDs, which are not normally encountered in vivo. In some embodiments, such non-natural peptides maintain orthogonality of the sCAR-switch interaction. The CAR-ID may be a non-immunogenic peptide (e.g., a peptide known to cause no immune response or a negligible immune response in the human body).

The CAR-ID may be based on or derived from a peptide expressed in animal selected from a chimpanzee, a monkey, a rat, a mouse, a bird, a fish, a pig, a horse, a cow, a goat, a chicken, a rabbit and a guinea pig. The CAR-ID may be based on or derived from a mammalian peptide. The CAR-ID may be based on or derived from a non-mammalian peptide. The CAR-ID may be based on or derived from a peptide expressed in a plant. The CAR-ID may be based on or derived from a peptide expressed in a bacterium. The CAR-ID may be based on or derived from a prokaryotic peptide. The CAR-ID may be based on or derived from a eukaryotic peptide. The CAR-ID may be based on or derived from a peptide expressed by a yeast.

The CAR-ID may comprise a yeast transcription factor GCN4 peptide or a derivative or a homolog thereof. The yeast transcription factor GCN4 peptide may comprise a GCN4(7P14P) peptide sequence (defined in Berger et al. FEBS Letters 450 (1999) 149-153, incorporated herein by reference in its entirety). The yeast transcription factor GCN4 peptide may comprise the sequence RMKQLEPKVEELLPKNYHLENEVARLKKLVGER (SEQ ID NO: 36). The yeast transcription factor GCN4 peptide may comprise the sequence NYHLENEVARLKKL (SEQ ID NO: 26). The yeast transcription factor GCN4 peptide may consist of the sequence RMKQLEPKVEELLPKNYHLENEVARLKKLVGER (SEQ ID NO: 36). The yeast transcription factor GCN4 peptide may consist of the sequence NYHLENEVARLKKL (SEQ ID NO: 26). The yeast transcription factor GCN4 peptide may comprise a portion of SEQ ID NO: 36. The portion of SEQ ID NO: 36 may be at least 4 amino acids long. The portion of SEQ ID NO: 36 may be about 4, about 5, about 6, about 7, about 8, about 9, about 10, about 11, about 12 or about 13 amino acids long. The yeast transcription factor GCN4 peptide may comprise a portion of SEQ ID NO: 36 that is 4 amino acids long, or a portion of SEQ ID NO: 36 that is 5, 6, 7, 8, 9, 10, 11, 12, or 13 amino acids long. The yeast transcription factor GCN4 peptide may comprise the sequence NYHLENEVARLKK (SEQ ID NO: 245). The yeast transcription factor GCN4 peptide may comprise the sequence NYHLENEVARLK (SEQ ID NO: 145). The yeast transcription factor GCN4 peptide may be at least about 50% identical to one or both of SEQ ID NOs: 26 or 36. The yeast transcription factor GCN4 peptide may be at least about 60% identical to one or both of SEQ ID NOs: 26 or 36. The yeast transcription factor GCN4 peptide may be at least about 70% identical to one or both of SEQ ID NOs: 26 or 36. The yeast transcription factor GCN4 peptide may be at least about 80% identical to one or both of SEQ ID NOs: 26 or 36. The yeast transcription factor GCN4 peptide may be at least about 85% identical to one or both of SEQ ID NOs: 26 or 36. The yeast transcription factor GCN4 peptide may be at least about 90% identical to one or both of SEQ ID NOs: 26 or 36. The CAR-EC switch may comprise a yeast GCN4 peptide and one or more linkers. The CAR-EC switch may comprise SEQ ID NO. 37. The yeast transcription factor GCN4 peptide may comprise or consist of a minimal binding epitope for an anti-GCN4 antibody. The yeast transcription factor GCN4 peptide may comprise or consist of a binding epitope (e.g., a minimal binding epitope) for the anti-GCN4 antibody scFv 52SR4 (described in described in Zahnd, C., et al., (2004), The Journal of Biological Chemistry 279, 18870-18877 (incorporated herein by reference in its entirety)), or an antibody comprising 1, 2, 3, 4, 5, or 6 of the CDR sequences comprised therein (CDR1 VL: RSSTGAVTTSNYAS; CDR2 VL: GTNNRAP; CDR3 VL: ALWYSNHWV; CDR1 VH: DYGVN; CDR2 VH: VIWGDGITDYNSALKS; CDR3 VH: GLFDY). The CAR-ID may comprise a sequence of Structure I: X1NYHLENEVARLKX2X3 (SEQ ID NO: 269), wherein $X_1$, $X_2$, and $X_3$ are optionally any amino acid or absent. In some embodiments, $X_1$ is K or absent. In some embodiments, $X_2$ is selected from K, A, and G. In some embodiments, $X_3$ is selected from L, A, and G. In some embodiments, the CAR-ID comprises or consists of a sequence selected from any one of SEQ ID NOS: 139, 154-163. KNYHLENEVARLKKL (SEQ ID NO: 154); KNYHLENEVARLKAL (SEQ ID NO: 155); KNYHLENEVARLKGL (SEQ ID NO: 156); KNYHLENEVARLKAA (SEQ ID NO: 157); KNYHLENEVARLKGG (SEQ ID NO: 158); NYHLENEVARLKKL (SEQ ID NO: 159); NYHLENEVARLKAL (SEQ ID NO: 160); NYHLENEVARLKGL (SEQ ID NO:161); NYHLENEVARLKAA (SEQ ID NO: 162); NYHLENEVARLKGG (SEQ ID NO: 163); and LLPKNYHLENEVARLKKL (SEQ ID NO: 139).

In some embodiments, by way of non-limiting example, the CAR-ID may comprise an isopeptag (TDKDMTITFTNKKDAE; SEQ ID NO: 41). The CAR-ID may comprise a SpyTag (AHIVMVDAYKPTK; SEQ ID NO: 42). The CAR-ID may comprise a SNARE. The CAR-ID may comprise a Hu-tag. The chimeric receptor binding partner may comprise a first alpha helix peptide that binds to a second alpha helix peptide such that the first alpha helix and the second alpha helix may form a coiled coil structure when bound. The CAR-ID may comprise the E4 peptide (EVAALEKEVAALEKEVAALEKEVAALEK; SEQ ID NO: 44). The CAR-ID may comprise the K4 peptide (KVAALKEKVAALKEKVAALKEKVAALKE; SEQ ID NO: 43). The CAR-ID may comprise a modified E4 peptide. The CAR-ID may comprise a modified K4 peptide. The CAR-ID may consist of a peptide having the sequence of SEQ ID NO: 44. The CAR-ID may consist of a peptide having the sequence of SEQ ID NO: 43. The CAR-ID may comprise a peptide having a sequence that has at least 85%, at least 90%, at least 95% or greater identity to SEQ ID NO: 43). The CAR-ID may comprise a peptide having a sequence that has at least 85%, at least 90%, at least 95% or greater identity to SEQ ID NO: 44. The CAR-ID may comprise a peptide having a sequence that has at least 85%, at least 90%, at least 95% or greater identity to any one of the following K4 or E4 peptides (SEQ ID NOS: 45-58):

```
                                       SEQ ID NO: 45
EVSALEKEVSALEKEVSALEKEVSALEK

SEQ ID NO: 46
KVSALKEKVSALKEKVSALKEKVSALKE

SEQ ID NO: 47
EIAALEKEIAALEKEIAALEK

SEQ ID NO: 48
EIAALEKEIAALEKEIAALEKEIAALEK

SEQ ID NO: 49
KIAALKEKIAALKEKIAALKE

SEQ ID NO: 50
KIAALKEKIAALKEKIAALKEKIAALKE

SEQ ID NO: 51
EISALEKEISALEKEISALEK

SEQ ID NO: 52
EISALEKEISALEKEISALEKEISALEK

SEQ ID NO: 53
KISALKEKISALKEKISALKE

SEQ ID NO: 54
KISALKEKISALKEKISALKEKISALKE

SEQ ID NO: 55
EVAALEKEVAALEKEVAALEK

SEQ ID NO: 56
KVAALKEKVAALKEKVAALKE
```

```
EVSALEKEVSALEKEVSALEK                SEQ ID NO: 57

KVSALKEKVSALKEKVSALKE                SEQ ID NO: 58
```

The CAR-ID may comprise a peptide having a sequence of any one of SEQ ID NOS: 45-58. A switch comprising a targeting moiety described herein and a CAR-ID comprising a peptide having a sequence of any one of SEQ ID NOS: 45, 47, 48, 51, 52, 55, and 57 may be paired with a CAR having a sequence of SEQ ID NO: 65 for use according to the present invention (e.g., such a switch may be used in combination with an effector cell expressing such a CAR to effect a treatment described herein). A switch comprising a targeting moiety described herein and a CAR-ID comprising a peptide having a sequence of any one of SEQ ID NOS: 46, 49, 50, 53, 54, 56, and 58 may be paired with a CAR having a sequence of SEQ ID NO: 64 for use according to the present invention (e.g., such a switch may be used in combination with an effector cell expressing such a CAR to effect a treatment described herein).

Also, by way of non-limiting example, the CAR-ID may comprise an alpha helix of a mouse coronin 1A protein. Also, by way of non-limiting example, the CAR-ID may comprise a dimerization and docking domain (DDD) of cAMP-dependent protein kinase A. The CAR-ID may comprise an anchoring domain (AD) of an A-kinase anchoring protein (AKAP). The CAR-ID may comprise DDD1 (SEQ ID NO: 60). The CAR-ID may comprise AD1 (SEQ ID NO: 59). The CAR-ID may comprise DDD2 (SEQ ID NO: 62). The CAR-ID may comprise AD2 (SEQ ID NO: 61).

Also, by way of non-limiting example, the CAR-ID may comprise a dimerization and docking domain of cAMP-dependent protein kinase A (e.g., DDD1 or DDD2), wherein the DDD has been modified with cysteines that form disulfide bonds between the DDD and an AD partner on a chimeric receptor (e.g., on the non-antibody extracellular domain). The CAR-ID may comprise a AD (e.g., AD1 or AD2), wherein the AD has been modified with cysteines that form disulfide bonds between the AD and a DDD partner on a chimeric receptor (e.g., on the non-antibody extracellular domain). These disulfide bonds may form a covalent interaction between AD1 and the DDD1 or between the AD2 and the DDD2. This may be advantageous to increase affinity of the non-antibody peptide for the CAR-ID, or vice versa.

Chimeric Receptor Binding Small Molecule.

In some embodiments, the CAR-ID comprises or consists of a small molecule. The small molecule may not comprise a peptide. The small molecule may not comprise two or more amino acids linked by an amide bond. The small molecule may be a small molecule that is bound by a protein or peptide. The small molecule may be a small molecule that is bound by a protein or peptide, wherein the protein or peptide is present in the non-antibody extracellular domain of the chimeric receptor. The small molecule may be a small molecule that is bound by a protein or peptide with a high affinity. The small molecule may be a drug. The small molecule may be an inorganic compound. The small molecule may be an organic compound. The small molecule may be naturally occurring. The small molecule may not be naturally occurring. The small molecule may be synthetic. The small molecule may be selected from a steroid, a vitamin, a vitamer, a ligand, a receptor agonist, a receptor antagonist, an enzyme inhibitor, a DNA aptamer, a peptide nucleic acid (PNA), a PNA aptamer, a petoid, a substrate, a substrate analog, a metabolite, an antibiotic, a monosaccharide, a disaccharide, a lipid, a fatty acid, a nucleic acid, an alkaloid, a glycoside, a phenzine, a polyketide, a terpene and a tetrapyrrole, and portions thereof. By way of non-limiting example, the small molecule may be selected from the group consisting of DOTA, dinitrophenol, quinone, biotin, aniline, atrazine, an aniline-derivative, o-aminobenzoic acid, p-aminobenzoic acid, m-aminobenzoic acid, hydralazine, halothane, digoxigenin, benzene arsonate, lactose, trinitrophenol, biotin or a derivative thereof.

The small molecule may comprise a vitamin or a derivative thereof. The vitamin, by non-limiting example may be selected from Vitamin A, Vitamin B, Vitamin C, Vitamin D, Vitamin E and Vitamin K. The vitamin may be Vitamin C. The vitamin may be Vitamin D. The vitamin may comprise folate or a derivative thereof. The small molecule may comprise a vitamer. The small molecule may comprise a vitamin metabolite or vitamin precursor. The vitamer, by non-limiting example, may be selected from retinol, retinal, beta carotene, a carotenoid, thiamine, riboflavin, niacin, niacinamide, pantothenic acid, pyridoxine, pyridoxamine, pyridoxal, biotin, folic acid, folinic acid, cyanocobalamin, hydroxycobalamin, methylcobalamin, ascorbic acid, cholecalciferol, ergocalciferol, a tocopherol, a tocotrienol, a phylloquinone, and a menaquinone or a derivative thereof. The small molecule may comprise an antioxidant or a derivative thereof.

The small molecule may be an enzyme inhibitor. The small molecule may be selected, by non-limiting example, from a tyrosine kinase inhibitor, a protease inhibitor, a growth factor receptor inhibitor, a hormone receptor inhibitor, a janus kinase inhibitor, an anaplastic lymphoma kinase (ALK) inhibitor, a Bcl-2 inhibitor, a poly ADP ribose polymerase (PARP) inhibitor, a PI3K inhibitor, a Braf inhibitor, a MAP kinase inhibitor, a cyclin dependent kinase inhibitor and a heat shock protein inhibitor. The enzyme inhibitor may be selected from apatinib, bortezomib, imatinib, ibrutinib, seliciclib, bosutinib, cabozantinib, crizotinib, dabrafenib, dasatinib, doxorubicin, erlotinib, everolimus, gefitinib, imatinib, iniparib, lapatinib, LEE011, LGX818, milotinib, obatoclax, olaparib, pazopanib, PD-0332991, perifosine, ponatinib, regorafenib, ruxolitinib, salinomycin, sorafebnib, sunitinib, tamoxifen, temsirolimus, tofacitinib, trametinib, vandetanib and vemurafenib or a derivative thereof.

The small molecule may be less than about 1000 Da, 1100 Da, 1200 Da, 1300 Da, 1400 Da, 1500 Da, 1600 Da, 1700 Da, 1800 Da, 1900, Da, 2000 Da, 2100 Da, 2200 Da, 2300 Da, 2400 Da, 2500 Da, 2600 Da, 2700 Da, 2800 Da, 2900, Da or less than about 3000 Da. The switch may be less than about 1200 Da. The switch may be less than about 1500 Da. The CAR-EC switch may be less than about 2000 Da.

The small molecule may have a size on the order of about $10^{-8}$ m, about $10^{-9}$ m, about $10^{-10}$ m. The small molecule may have a size of less than about $10^{-7}$ m. The small molecule may have a size of less than about $10^{-8}$ m. The small molecule may have a size of less than about $10^{-9}$ m. The small molecule may have a size of less than about $10^{-10}$ m. The small molecule may have a size of less than about $10^{-11}$ m. The small molecule may be less than about 10 nm, less than about 20 nm, less than about 30 nm, less than about 40 nm, less than about 50 nm, less than about 60 nm, less than about 70 nm, less than about 80 nm, less than about 90 nm, less than about 100 nm, less than about 110 nm, less than about 120 nm, less than about 130 nm, less than about 140 nm, less than about 150 nm, less than about 160 nm, less than about 170 nm, less than about 180 nm, less than about 190 nm, or less than about 200 nm wide at its widest dimension. The small molecule may be less than about 100 nm, less than about 200 nm wide, less than about 300 nm, less than about 400 nm, less than about 500 nm, less than about 600 nm, less than about 700 nm, less than about 800 nm, less than about 900 nm, or less than about 1000 nm wide, at its widest dimension.

The CAR-ID may comprise a hapten. The CAR-ID may induce an immune response when attached to a larger carrier molecule, such as a protein, antibody or antibody fragment. The CAR-ID may be Fluorescein isothiocyanate (FITC) or a derivative thereof. The CAR-ID may comprise biotin. The CAR-ID may comprise dinitrophenol.

Alternatively, the CAR-ID does not comprise a hapten. The CAR-ID may be selected from a steroid, a vitamin, a vitamer, a metabolite, an antibiotic, a monosaccharide, a disaccharide, a lipid, a fatty acid, a nucleic acid, an alkaloid, a glycoside, a phenzine, a polyketide, a terpene, and a tetrapyrrole, and portions thereof, and combinations thereof. The CAR-ID may be a penicillin drug or a derivative thereof.

The CAR-ID may be linked and/or conjugated to the targeting moiety. The targeting moiety may be a targeting antibody or an antigen binding portion of a targeting antibody and the CAR-ID may be linked and/or conjugated to an amino acid of the targeting antibody or antigen binding portion of an antibody. The amino acid of the targeting antibody or antigen binding portion of an antibody may be an unnatural amino acid. The targeting antibody or antigen binding portion of an antibody may be any targeting antibody or antigen binding portion of an antibody disclosed herein. The targeting antibody or antigen binding portion of an antibody may comprise a light chain selected from SEQ ID NOS: 17-25. The targeting antibody or antigen binding portion of an antibody may comprise a light chain selected from SEQ ID NOS: 17-25 and the unnatural amino acids may be located at respective sites shown in Table 1. The targeting antibody or antigen binding portion of an antibody may comprise a heavy chain selected from SEQ ID NOS: 2-15. The targeting antibody or antigen binding portion of an antibody may comprise a heavy chain selected from SEQ ID NOS: 2-15 and the unnatural amino acids may be located at respective sites shown in Table 1.

TABLE 1

| Antigen | clone | A | B | C | D | E | F |
|---|---|---|---|---|---|---|---|
| CD19 | FMC63 | LG68 | HS74 | LT109 | HA121 | LS202 | HK136 |

L = light chain, H = heavy chain, S = serine, G = glycine, R = arginine, T = threonine, A = alanine and K = lysine The targeting antibody or antigen binding portion of an antibody may be an anti-CD20 antibody or anti-CD20 antibody fragment. The targeting antibody or antigen binding portion of an antibody may be an anti-CD22 antibody or anti-CD22 antibody fragment. The targeting antibody or antigen binding portion of an antibody may be an anti-CD33 antibody or anti-CD33 antibody fragment. The targeting antibody or antigen binding portion of an antibody may be an anti-CD123 antibody or anti-CD123 antibody fragment. The targeting antibody or antigen binding portion of an antibody may be an anti-CLL1 antibody or anti-CLL1 antibody fragment. The targeting antibody or antigen binding portion of an antibody may be an anti-CEA antibody or anti-CEA antibody fragment. The targeting antibody or antigen binding portion of an antibody may be an anti-Her2 antibody or anti-Her2 antibody fragment. The targeting antibody or antigen binding portion of an antibody may be an anti-BCMA antibody or anti-BCMA antibody fragment. The targeting antibody or antigen binding portion of an antibody may be an anti-CS1 antibody or anti-CS1 antibody fragment. The targeting moiety may be a T cell receptor. The targeting moiety may be a soluble T cell receptor. The targeting soluble T cell receptor may bind an MHC-restricted NY-ESO-1 peptide.

The targeting antibody or antigen binding portion of an antibody may comprise a light chain selected from SEQ ID NOS: 247, 249, 251, 253, 255, 257, 259, 261, 263, 265, and 267. The targeting antibody or antigen binding portion of an antibody may comprise a light chain selected from SEQ ID NOS: 247, 249, 251, 253, 255, 257, 259, 261, 263, 265, and 267 and the unnatural amino acids may be located at respective sites shown in Table 2. The targeting antibody or antigen binding portion of an antibody may comprise a heavy chain selected from SEQ ID NOS: 248, 250, 252, 254, 256, 258, 260, 262, 264, 266, 268. The targeting antibody or antigen binding portion of an antibody may comprise a heavy chain selected from SEQ ID NOS: 248, 250, 252, 254, 256, 258, 260, 262, 264, 266, 268 and the unnatural amino acids may be located at respective sites shown in Table 2.

TABLE 2

| Antigen | clone | A | B | C | D | E | F |
|---|---|---|---|---|---|---|---|
| CD22 | hLL2 | LG74 | HS75 | LT114 | HA117 | LS207 | HK132 |
|  | M971 | LG68 | HS78 | LT109 | HA125 | LS202 | HK140 |
| Her2 | Herceptin | LG68 | HS75 | LT109 | HA121 | LS202 | HK136 |
| CLL1 | 1075.7 | LG69 | HS75 | LA110 | HA124 | LS203 | HK139 |
| CD33 | hM195 | LG72 | HS75 | LT113 | HA117 | LS206 | HK132 |
|  | Hp67.6 | LG72 | HP75 | LT113 | HA117 | LS206 | HK132 |
| CD123 | 26292 | LG68 | HS75 | LT109 | HA116 | LS202 | HK131 |
|  | 32716 | LR72 | HS75 | LT113 | HA119 | LS206 | HK134 |

L = light chain, H = heavy chain, S = serine, G = glycine, R = arginine, T = threonine, A = alanine and K = lysine The one or more unnatural amino acids may be encoded by a codon that does not code for one of the twenty natural amino acids. The one or more unnatural amino acids may be encoded by a nonsense codon (stop codon). The stop codon may be an amber codon. The amber codon may comprise a UAG sequence. Herein, "UAG" and "TAG" may be used interchangeably in reference to amber codons. The stop codon may be an ochre codon. The ochre codon may comprise a UAA sequence. The stop codon may be an opal or umber codon. The opal or umber codon may comprise a UGA sequence. The one or more unnatural amino acids may be encoded by a four-base codon.

The one or more unnatural amino acids may be p-acetylphenylalanine (pAcF or pAcPhe). The one or more unnatural amino acids may be selenocysteine. The one or more unnatural amino acids may be p-fluorophenylalanine (pFPhe). The one or more unnatural amino acids may be selected from the group comprising p-azidophenylalanine (pAzF), p-azidomethylphenylalanine (pAzCH2F), p-benzoylphenylalanine (pBpF), p-propargyloxyphenylalanine (pPrF), p-iodophenylalanine (pIF), p-cyanophenylalanine (pCNF), p-carboxylmethylphenylalanine (pCmF), 3-(2-naphthyl)alanine (NapA), p-boronophenylalanine (pBoF), o-nitrophenylalanine (oNiF), (8-hydroxyquinolin-3-yl)alanine (HQA), selenocysteine, and (2,2'-bipyridin-5-yl)alanine (BipyA). The one or more unnatural amino acids may be 4-(6-methyl-s-tetrazin-3-yl)aminophenylalanine.

The one or more unnatural amino acids may be β-amino acids (β3 and β2), homo-amino acids, proline and pyruvic acid derivatives, 3-substituted alanine derivatives, glycine derivatives, ring-substituted phenylalanine and tyrosine derivatives, linear core amino acids, diamino acids, D-amino acids, N-methyl amino acids, or a combination thereof.

Additional examples of unnatural amino acids include, but are not limited to, 1) various substituted tyrosine and phenylalanine analogues such as O-methyl-L-tyrosine, p-amino-L-phenylalanine, 3-nitro-L-tyrosine, p-nitro-L-phenylalanine, m-methoxy-L-phenylalanine and p-isopropyl-L-phenylalanine; 2) amino acids with aryl azide and benzophenone groups that may be photo-cross-linked; 3) amino acids that have unique chemical reactivity including acetyl-L-phenylalanine and m-acetyl-L-phenylalanine, O-allyl-L-tyrosine, O-(2-propynyl)-L-tyrosine, p-ethylthiocarbonyl-L-phenylalanine and p-(3-oxobutanoyl)-L-phenylalanine; 4) heavy-atom-containing amino acids for phasing in X-ray crystallography including p-iodo and p-bromo-L-phenylalanine; 5) the redox-active amino acid dihydroxy-L-phenylalanine; 6) glycosylated amino acids including b-N-acetylglucosamine-O-serine and a-N-acetylgalactosamine-O-threonine; 7) fluorescent amino acids with naphthyl, dansyl, and 7-aminocoumarin side chains; 8) photocleavable and photoisomerizable amino acids with azobenzene and nitrobenzyl Cys, Ser, and Tyr side chains; 9) the phosphotyrosine mimetic p-carboxymethyl-L-phenylalanine; 10) the glutamine homologue homoglutamine; and 11) 2-aminooctanoic acid. The unnatural amino acid may be modified to incorporate a chemical group. The unnatural amino acid may be modified to incorporate a ketone group.

The one or more unnatural amino acids may comprise at least one oxime, carbonyl, dicarbonyl, hydroxylamine group or a combination thereof. The one or more unnatural amino acids may comprise at least one carbonyl, dicarbonyl, alkoxy-amine, hydrazine, acyclic alkene, acyclic alkyne, cyclooctyne, aryl/alkyl azide, norbornene, cyclopropene, trans-cyclooctene, or tetrazine functional group or a combination thereof.

The one or more unnatural amino acids may be incorporated into the targeting moiety and/or the CAR-ID by methods known in the art. Cell-based or cell-free systems may be used to alter the genetic sequence of the targeting moiety and/or the CAR-ID, thereby producing the targeting moiety and/or the CAR-ID with one or more unnatural amino acids. Auxotrophic strains may be used in place of engineered tRNA and synthetase. The one or more unnatural amino acids may be produced through selective reaction of one or more natural amino acids. The selective reaction may be mediated by one or more enzymes. In one non-limiting example, the selective reaction of one or more cysteines with formylglycine generating enzyme (FGE) may produce one or more formylglycines (see Rabuka et al., Nature Protocols 7:1052-1067 (2012), which is incorporated by reference in its entirety).

The one or more unnatural amino acids may take part in a chemical reaction to form a linker. The chemical reaction to form the linker may be a bioorthogonal reaction. The chemical reaction to form the linker may be click chemistry.

Additional unnatural amino acids are disclosed in Liu et al. (Annu Rev Biochem, 79:413-44, 2010), Wang et al. (Angew Chem Int Ed, 44:34-66, 2005) and PCT application numbers PCT/US2012/039472, PCT/US2012/039468, PCT/US2007/088009, PCT/US2009/058668, PCT/US2007/089142, PCT/US2007/088011, PCT/US2007/001485, PCT/US2006/049397, PCT/US2006/047822 and PCT/US2006/044682, all of which are incorporated by reference in their entireties.

Second Region of the CAR-EC Switch: Targeting Moiety.

CAR-EC Switches comprise a CAR-ID and a targeting moiety.

The targeting moiety may bind to a cell surface molecule on a target. The cell surface molecule may comprise an antigen. The cell surface molecule may be selected from a protein, a lipid moiety, a glycoprotein, a glycolipid, a carbohydrate, a polysaccharide, a nucleic acid, an MHC-bound peptide, or a combination thereof. The cell surface molecule may comprise parts (e.g., coats, capsules, cell walls, flagella, fimbrae, and toxins) of bacteria, viruses, and other microorganisms. The cell surface molecule may be expressed by the target cell. The cell surface molecule may not be expressed by the target cell. By way of non-limiting example, the cell surface molecule may be a ligand expressed by a cell that is not the target cell and that is bound to the target cell or a cell surface molecule of the target cell. Also, by non-limiting example, the cell surface molecule may be a toxin, exogenous molecule or viral protein that is bound to a cell surface or cell surface receptor of the target cell.

The targeting moiety may be a targeting polypeptide. The targeting polypeptide may be a targeting antibody or antibody fragment. The antibody fragment may be an antigen binding portion of an antibody. The targeting antibody or antibody fragment may be an immunoglobulin (Ig). The immunoglobulin may be selected from an IgG, an IgA, an IgD, an IgE, an IgM, a fragment thereof (e.g., an antigen binding fragment or portion) or a modification thereof. The immunoglobulin may be IgG. The IgG may be IgG1. The IgG may be IgG2. The IgG may have one or more Fc mutations for modulating endogenous T cell FcR binding to the CAR-EC switch. The IgG may have one or more Fc mutations for removing the Fc binding capacity to the FcR of FcR-positive cells. Removal of the Fc binding capacity may reduce the opportunity for crosslinking of the CAR-EC to FcR positive cells, wherein crosslinking of the CAR-EC to FcR positive cells would activate the CAR-EC in the absence of the target cell. As such, modulating the endogenous T cell FcR binding to the CAR-EC switch may reduce an ineffective or undesirable immune response. The one or more Fc mutations may remove a glycosylation site. The one or more Fc mutations may be selected from E233P, L234V, L235A, delG236, A327G, A330S, P331S, N297Q and any combination thereof. The one or more Fc mutations may be in IgG1. The one or more Fc mutations in the IgG1 may be L234A, L235A, or both. Alternatively, or additionally, the one or more Fc mutations in the IgG1 may be L234A, L235E, or both. Alternatively, or additionally, the one or more Fc mutations in the IgG1 may be N297A. Alternatively, or additionally, the one or more mutations may be in IgG2. The one or more Fc mutations in the IgG2 may be V234A, V237A, or both.

The targeting antibody or antibody fragment may be an Fc null immunoglobulin or a fragment thereof.

The targeting antibody or antigen binding portion of an antibody may be a Fab. In some embodiments, a central tenant of the sCAR-T cells described herein is the orthogonality of CAR-ID-grafted switches in that they only interact with the target cell and sCAR and no other immune receptors or cell types. Lack of orthogonality has the potential to cause off-target effects. Thus, in some embodiments, Fabs may be desirable because their lack of an Fc domain removes the possibility of an Fc receptor-mediated off target binding. In some embodiments, their smaller size and shorter half-life (approximately 1-5 h for Fab vs 10-20 d for IgG provides better tumor penetration and greater temporal control over sCAR-T cell activation, in clinical translation. In addition, the Fab may differ from the IgG in valency, off-rate, or tissue distribution.

The targeting antibody fragment may be human, fully human, humanized, human engineered, non-human, and/or chimeric antibody. The non-human antibody may be humanized to reduce immunogenicity to humans, while retaining the specificity and affinity of the parental non-human antibody. Chimeric antibodies may refer to antibodies created through the joining of two or more antibody genes which originally encoded for separate antibodies. A chimeric antibody may comprise at least one amino acid from a first antibody and at least one amino acid from a second antibody, wherein the first and second antibodies are different. At least a portion of the antibody or antibody fragment may be from a bovine species, a human species, or a murine species. At least a portion of the antibody or antibody fragment may be from a rat, a goat, a guinea pig or a rabbit. At least a portion of the antibody or antibody fragment may be from a human. At least a portion of the antibody or antibody fragment antibody may be from cynomolgus monkey.

The targeting antibody or antibody fragment may be based on or derived from an antibody or antibody fragment from a mammal, bird, fish, amphibian, or reptile. Mammals include, but are not limited to, carnivores, rodents, elephants, marsupials, rabbits, bats, primates, seals, anteaters, cetaceans, odd-toed ungulates and even-toed ungulates. The mammal may be a human, non-human primate, mouse, sheep, cat, dog, cow, horse, goat, or pig.

In some embodiments, the targeting moiety comprised on the humanized CAR-EC switches disclosed herein is humanized. In some embodiments, the targeting moiety comprised on the humanized CAR-EC switches disclosed herein is humanized, and it binds CD19. In some embodiments, the targeting moiety specifically binds CD19 (i.e., no substantial off-target binding occurs or is observable). In some embodiments, the targeting moiety is an anti-CD19 antibody, or an antigen binding fragment of an anti-CD19 antibody. In particular embodiments, the targeting moiety comprises or consists of a humanized anti-CD19 antibody, or an antigen binding fragment of a humanized anti-CD19 antibody (e.g., any one of more of the humanized anti-CD19 antibodies or antigen binding fragments thereof disclosed herein). In particular embodiments, the targeting moiety comprises a humanized form of the anti-CD19 murine clone FMC63 antibody.

The targeting antibody or an antibody fragment may target an antigen selected from, by non-limiting example, CD19, Her2, CLL1, CD33, CD123, EGFR, EGFRvIII, CD20, CD22, CS1, BCMA, CEA or a fragment thereof. The antigen may comprise a wildtype antigen. The antigen may comprise one or more mutations. The targeting antibody or antibody fragment may be a B cell targeting moiety. The targeting antibody or antibody fragment may be an anti-CD19 antibody or antibody fragment. The anti-CD19 antibody or antibody fragment may be selected from antibody clone huB4 (see, e.g., SEQ ID NOS: 223-224), FMC63 (see, e.g., SEQ ID NOS: 2-15, 17-25, 184-185), and 1D3 (see, e.g., SEQ ID NO: 207-208). The targeting antibody or antibody fragment may be an anti-CLL1 antibody or antibody fragment. The anti-CLL1 antibody or antibody fragment may be antibody clone 1075.7 (see, e.g., SEQ ID NOS: 193-194). The targeting antibody or antibody fragment may be an anti-CD123 antibody or antibody fragment. The anti-CD123 antibody or antibody fragment may be selected from antibody clone 32716 (see, e.g., SEQ ID NOS: 239-240) and 26292 (see, e.g., SEQ ID NOS: 241-242). The targeting antibody or antibody fragment may be an anti-CD22 antibody or antibody fragment. The anti-CD22 antibody or antibody fragment may be selected from antibody clone m972 (see, e.g., SEQ ID NOS: 211-212) and m971 (see, e.g., SEQ ID NOS: 209-210). The targeting antibody or antibody fragment may be an anti-CD20 antibody or antibody fragment. The anti-CD20 antibody or antibody fragment may be selected from antibody clone OFA (see, e.g., SEQ ID NOS: 219-220), RTX (see, e.g., SEQ ID NOS: 215-216), and GA101 (see, e.g., SEQ ID NOS: 217-218). The targeting antibody or antibody fragment may be an anti-BCMA antibody or antibody fragment. The anti-BCMA antibody or antibody fragment may be antibody clone BCMA-98 (see, e.g., SEQ ID NOS: 221-222. The targeting antibody or antibody fragment may be an anti-Her2 antibody or antibody fragment. The anti-Her2 antibody or antibody fragment may be selected from antibody clone trastuzumab (see, e.g., SEQ ID NOS: 187-188). The targeting antibody or antibody fragment may be an anti-CS1 antibody or antibody fragment. The anti-CS1 antibody or antibody fragment may be antibody clone elotuzumab (see, e.g., SEQ ID NOS: 243-244). The targeting antibody or antibody fragment may be an anti-CD33 antibody or antibody fragment. The anti-CD33 antibody or antibody fragment may be selected from antibody clone hM195 (see, e.g., SEQ ID NOS: 259-260) and HP67.6 (see, e.g., SEQ ID NOS: 237-238. The targeting antibody or antibody fragment may be an anti-EGFR antibody or antibody fragment. The anti-EGFR antibody or antibody fragment may be clone C225 (see e.g., SEQ ID NOS: 191-192). The targeting antibody or antibody fragment may be an anti-EGFRvIII antibody or antibody fragment. The anti-EGFRvIII antibody or antibody fragment may be clone Hu806 (see, e.g., SEQ ID NOS: 199-200). The targeting antibody or antibody fragment may be an anti-CEA antibody or antibody fragment. The anti-CEA antibody or antibody fragment may be antibody clone A5B7 (see, e.g., SEQ ID NOS: 225-226). The expression of each switch requires a heavy chain and light chain. In some embodiments, expression of each switch requires a heavy chain and light chain gene to be co-transfected into one or more expression cells (e.g., HEK). The CAR-ID may be located in only the heavy chain to provide a monovalent switch. The CAR-ID may be located in only the light chain to provide a monovalent switch. The CAR-ID may be located in both the heavy chain and the light chain to provide a bivalent switch. The CAR-ID may be located in both the heavy chain and the light chain to provide a multivalent switch.

The targeting antibody or antibody fragment may be an anti-CD19 antibody or a fragment thereof. The targeting polypeptide may be an anti-CD22 antibody. The targeting polypeptide may be an anti-BCMA antibody or a fragment thereof. The targeting polypeptide may be an anti-CS1 antibody or a fragment thereof. The targeting polypeptide may be an anti-EGFRvIII antibody or a fragment thereof. The targeting polypeptide may be an anti-Her2 antibody or a fragment thereof. The targeting polypeptide may comprise an anti-CD20 antibody or antibody fragment. The targeting polypeptide may comprise rituximab. The targeting polypeptide may comprise an anti-EGFR antibody or antibody fragment. The targeting polypeptide may comprise an anti-CEA antibody or antibody fragment. The targeting polypeptide may comprise an anti-CLL1 antibody or antibody fragment. The targeting polypeptide may comprise an anti-CD123 antibody or antibody fragment. The targeting polypeptide may comprise an anti-CD33 antibody or antibody fragment. The targeting polypeptide may not comprise an anti-EpCAM antibody or fragment thereof.

The targeting antibody or antibody fragment may be selected any commercially available antibody. The targeting antibody or antibody fragment may be selected from adotrastuzumab emtansine, alemtuzumab, bevacizumab, brentuximab, vedotin, gemtuzumab, ozogamicin, ipilimumab, ibritumomab, tiuxetan, panitumumab, cetuximab, erbitux, rituximab, trastuzumab and fragments thereof.

The targeting antibody or antibody fragment may comprise an anti-CD19 antibody or fragment thereof. The targeting antibody or fragment thereof may comprise a light chain of the anti-CD19 antibody or fragment thereof. The light chain of the anti-CD19 antibody or fragment thereof may be encoded by a nucleotide sequence based on or derived from SEQ ID NO. 184. The nucleotide sequence may be about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 184. The targeting antibody or fragment thereof may comprise a heavy chain of the anti-CD19 antibody or fragment thereof. The heavy chain of the anti-CD19 antibody or fragment thereof may be encoded by a sequence based on or derived from SEQ ID NO. 185. The nucleotide sequence may be about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 185

The light chain of the anti-CD19 antibody or fragment thereof may be encoded by a nucleotide sequence based on or derived from a sequence selected from SEQ ID NOS: 207 and 223. The nucleotide sequence of the light chain may be about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to a sequence selected from SEQ ID NOS: 207 and 223. The targeting antibody or fragment thereof may comprise a heavy chain of the anti-CD19 antibody or fragment thereof. The heavy chain of the anti-CD19 antibody or fragment thereof may be encoded by a sequence based on or derived from a sequence selected from SEQ ID NOS: 208 and 224. The nucleotide sequence of the heavy chain may be about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to a sequence selected from SEQ ID NOS: 208 and 224.

The targeting antibody or antibody fragment may comprise an anti-CD19 antibody or fragment thereof. The targeting antibody or fragment thereof may comprise a light chain of the anti-CD19 antibody or fragment thereof. The light chain of the anti-CD19 antibody or fragment may comprise an amino acid sequence based on or derived from a sequence selected from SEQ ID NOS: 25 and 203. The amino acid sequence may be about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NOS: 25 and 203. The targeting antibody or fragment thereof may comprise a heavy chain of the anti-CD19 or fragment thereof. The targeting antibody or fragment thereof may comprise a heavy chain of an anti-CD19 IgG. The heavy chain of the anti-CD19 IgG may comprise a sequence based on or derived from a sequence selected from SEQ ID NOS: 15 and 204. The amino acid sequence may be about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to a sequence selected from SEQ ID NOS: 15 and 204. The targeting antibody or fragment thereof may comprise a heavy chain of an anti-CD19 Fab. The heavy chain of the anti-CD19 Fab may comprise a sequence based on or derived from SEQ ID NO. 205. The targeting antibody or fragment thereof may comprise a heavy chain of an anti-CD19 Fab comprising or consisting of an amino acid sequence that may be about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 205.

The targeting antibody or fragment thereof may comprise a light chain of the anti-CLL1 antibody or fragment thereof. The light chain of the anti-CLL1 antibody or fragment thereof may be encoded by SEQ ID NO. 193. The light chain of the anti-CLL1 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 193. The targeting antibody or fragment thereof may comprise a heavy chain of the anti-CLL1 antibody or fragment thereof. The heavy chain of the anti-CLL1 antibody or fragment thereof may be encoded by SEQ ID NO. 194. The heavy chain of the anti-CLL1 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 194.

The targeting antibody or fragment thereof may comprise a light chain of the anti-CD22 antibody or fragment thereof. The light chain of the anti-CD22 antibody or fragment thereof may be encoded by a sequence selected from SEQ ID NOS:10, 12, and 14. The light chain of the anti-CD22 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to a sequence selected from SEQ ID NOS: 10, 12, and 14. The targeting antibody or fragment thereof may comprise a heavy chain of the anti-CD22 antibody or fragment thereof. The heavy chain of the anti-CD22 antibody or fragment thereof may be a sequence selected from SEQ ID NOS:211, and 213. The heavy chain of the anti-CD22 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to a sequence selected from SEQ ID NOS: 211, 213.

The targeting antibody or fragment thereof may comprise a light chain of the anti-CD20 antibody or fragment thereof. The light chain of the anti-CD20 antibody or fragment thereof may be encoded by a sequence selected from SEQ ID NOS: 189, 216, 218, and 220. The light chain of the anti-CD20 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to a sequence selected from SEQ ID NOS: 189, 216, 218, and 220 The targeting antibody or fragment thereof may comprise a heavy chain of the anti-CD20 antibody or fragment thereof. The heavy chain of the anti-CD20 antibody or fragment thereof may be a sequence selected from SEQ ID NOS: 190, 215, 217, and 219. The heavy chain of the anti-CD20 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to a sequence selected from SEQ ID NOS: 190, 215, 217, and 219. The chimeric antigen receptor-effector cell switch may comprise a heavy chain of SEQ ID NOS: 190, 215, 217, and 219 and a light chain of SEQ ID NOS: 189, 216, 218, and 220, or homologs thereof or fragments thereof.

The targeting antibody or fragment thereof may comprise a light chain of the anti-Her2 antibody or fragment thereof. The light chain of the anti-Her2 antibody or fragment thereof may be encoded by SEQ ID NO. 187. The light chain of the anti-Her2 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 187. The targeting antibody or fragment thereof may comprise a heavy chain of the anti-Her2 antibody or fragment thereof. The heavy chain of the anti-Her2 antibody or fragment thereof may be encoded by SEQ ID NO. 188. The heavy chain of the anti-Her2 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 188. The chimeric antigen receptor-effector cell switch may comprise a heavy chain of SEQ ID NO. 188 and a light chain of SEQ ID NO. 187, or homologs thereof, or fragments thereof.

The targeting antibody or fragment thereof may comprise a light chain of the anti-BCMA antibody or fragment thereof. The light chain of the anti-BCMA antibody or fragment thereof may be encoded by SEQ ID NO. 222. The light chain of the anti-BCMA antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 222. The targeting antibody or fragment thereof may comprise a heavy chain of the anti-BCMA antibody or fragment thereof. The heavy chain of the anti-BCMA antibody or fragment thereof may be encoded by a sequence selected from SEQ ID NOS: 221. The heavy chain of the anti-BCMA antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to a sequence selected from SEQ ID NOS: 221. The chimeric antigen receptor-effector cell switch may comprise a heavy chain of SEQ ID NOS: 221 and a light chain of SEQ ID NO. 222, or homologs thereof, or fragments thereof.

The targeting antibody or fragment thereof may comprise a light chain of the anti-CEA antibody or fragment thereof. The light chain of the anti-CEA antibody or fragment thereof may be encoded by SEQ ID NO. 226. The light chain of the anti-CEA antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 226. The targeting antibody or fragment thereof may comprise a heavy chain of the anti-CEA antibody or fragment thereof. The heavy chain of the anti-CEA antibody or fragment thereof may be encoded by SEQ ID NO. 225. The heavy chain of the anti-CEA antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 225. The chimeric antigen receptor-effector cell switch may comprise a heavy chain of SEQ ID NO. 225 and a light chain of SEQ ID NO. 226, or homologs thereof, or fragments thereof.

The targeting antibody or fragment thereof may comprise a light chain of the anti-CS1 antibody or fragment thereof. The light chain of the anti-CS1 antibody or fragment thereof may be encoded by SEQ ID NO. 243. The light chain of the anti-CS1 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 243. The targeting antibody or fragment thereof may comprise a heavy chain of the anti-CS1 antibody or fragment thereof. The heavy chain of the anti-CS1 antibody or fragment thereof may be encoded by SEQ ID NO. 244. The heavy chain of the anti-CS1 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 244. The chimeric antigen receptor-effector cell switch may comprise a heavy chain of SEQ ID NO. 244 and a light chain of SEQ ID NO. 243, or homologs thereof, or fragments thereof.

The targeting antibody or fragment thereof may comprise a light chain of the anti-CD33 antibody or fragment thereof. The light chain of the anti-CD33 antibody or fragment thereof may be encoded by SEQ ID NO. 195. The light chain of the anti-CD33 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 195. The targeting antibody or fragment thereof may comprise a heavy chain of the anti-CD33 antibody or fragment thereof. The heavy chain of the anti-CD33 antibody or fragment thereof may be encoded by SEQ ID NO. 196. The heavy chain of the anti-CD33 antibody or fragment thereof may be encoded by a sequence at least about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to SEQ ID NO. 196. The chimeric antigen receptor-effector cell switch may comprise a heavy chain of SEQ ID NO. 196 and a light chain of SEQ ID NO. 195, or homologs thereof, or fragments thereof.

The targeting antibody or antibody fragment may comprise a nucleotide sequence selected from SEQ ID NOs: 184-196, 207-236. The targeting polypeptide may be based on or derived from a nucleotide selected from SEQ ID NOs: 184-196, 207-236. The targeting antibody or antibody fragment may comprise a humanized form of a nucleotide sequence selected from SEQ ID NOs: 184-196, 207-236.

The targeting antibody or antibody fragment may comprise an amino acid sequence selected from SEQ ID NOs: 2-15, 17-25, 27-35, 197-206, 237-244, 246-266. The targeting polypeptide may be based on or derived from an amino acid sequence selected from SEQ ID NOs: 2-15, 17-25, 27-35, 197-206, 237-244, 246-266. The targeting antibody or antibody fragment may comprise a humanized form of an amino acid sequence selected from SEQ ID NOs: 2-15, 17-25, 27-35, 197-206, 237-244, 246-266.

Thus, the targeting moiety may be, e.g., an immunoglobulin (Ig) that binds CD19. The immunoglobulin may be selected from an IgG, an IgA, an IgD, an IgE, an IgM, an antigen-binding fragment thereof, and a modification thereof. The immunoglobulin may be IgG. The IgG may be IgG1. The IgG may be IgG2. The IgG may have one or more Fc mutations for modulating endogenous T cell FcR binding to the switch. The IgG may have one or more Fc mutations for removing the Fc binding capacity to the FcR of FcR-positive cells. Removal of the Fc binding capacity may reduce the opportunity for crosslinking of the chimeric receptor-EC to FcR positive cells, wherein crosslinking of the chimeric receptor-EC to FcR positive cells would activate the chimeric receptor-EC in the absence of the target cell. As such, modulating the endogenous T cell FcR binding to the chimeric receptor-EC switch may reduce an ineffective or undesirable immune response. The one or more Fc mutations may remove a glycosylation site. The one or more Fc mutations may be selected from E233P, L234V, L235A, delG236, A327G, A330S, P331S, N297Q and any combination thereof. The one or more Fc mutations may be in IgG1. The one or more Fc mutations in the IgG1 may be L234A, L235A, or both. Alternatively, or additionally, the one or more Fc mutations in the IgG1 may be L234A, L235E, or both. Alternatively, or additionally, the one or more Fc mutations in the IgG1 may be N297A. Alternatively, or additionally, the one or more mutations may be in IgG2. The one or more Fc mutations in the IgG2 may be V234A, V237A, or both.

The targeting moiety may be an Fc null immunoglobulin that binds CD19, or an antigen-binding fragment thereof.

The targeting moiety may be human, fully human, humanized, human engineered, non-human, and/or chimeric antibody. The non-human antibody may be humanized to reduce immunogenicity to humans, while retaining the specificity and affinity of the parental non-human antibody. Chimeric antibodies may refer to antibodies created through the joining of two or more antibody genes which originally encoded for separate antibodies. A chimeric antibody may comprise at least one amino acid from a first antibody and at least one amino acid from a second antibody, wherein the first and second antibodies are different. At least a portion of the targeting moiety may be from a bovine species, a human species, or a murine species. At least a portion of the targeting moiety may be from a rat, a goat, a guinea pig or a rabbit. At least a portion of the targeting moiety may be from a human. At least a portion of the targeting moiety may be from cynomolgus monkey. The targeting moiety may be a humanized single domain antibody. The single domain antibody may be a humanized camelid.

The targeting moiety may be based on or derived from an anti-CD19 antibody or a CD19-binding antibody fragment from, e.g., a mammal, bird, fish, amphibian, reptile. Mammals include, but are not limited to, carnivores, rodents, elephants, marsupials, rabbits, bats, primates, seals, anteaters, cetaceans, odd-toed ungulates and even-toed ungulates. The mammal may be a human, non-human primate, mouse, sheep, cat, dog, cow, horse, goat, or pig.

The targeting moiety may comprise a humanized anti-CD19 antibody or an antigen-binding fragment thereof. The targeting moiety may comprise a humanized FMC63 antibody or an antigen-binding fragment thereof. The anti-CD19 antibody or antigen-binding fragment thereof may comprise a humanized light chain of the anti-CD19 antibody or an antigen-binding fragment thereof. The targeting moiety may comprise a humanized light chain of the FMC63 antibody (SEQ ID NO: 25) or an antigen-binding fragment thereof. The anti-CD19 antibody or antigen-binding fragment thereof may comprise a humanized light chain of the FMC63 antibody, or an antigen-binding fragment thereof. The humanized light chain of the anti-CD19 antibody or antigen-binding fragment may comprise an amino acid sequence of any one of SEQ ID NOS: 17-25 or any one of SEQ ID NOS: 27-35. The amino acid sequence of the humanized light chain of the anti-CD19 antibody or antigen-binding fragment may be about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to any one of SEQ ID NOS: 17-25 or any one of SEQ ID NOS: 27-35. The targeting moiety may comprise a humanized heavy chain of the anti-CD19 antibody or an antigen-binding fragment thereof. The anti-CD19 antibody or antigen-binding fragment thereof may comprise a humanized heavy chain of the anti-CD19 antibody or an antigen-binding fragment thereof. The targeting moiety may comprise a humanized heavy chain of the FMC63 antibody (SEQ ID NO: 15) or an antigen-binding fragment thereof. The anti-CD19 antibody or antigen-binding fragment thereof may comprise a humanized heavy chain of the FMC63 antibody, or an antigen-binding fragment thereof. The humanized heavy chain of the anti-CD19 antibody or antigen-binding fragment may comprise an amino acid sequence of any one of SEQ ID NOS: 2-15. The amino acid sequence of the humanized heavy chain of the anti-CD19 antibody or antigen-binding fragment may be about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical to any one of SEQ ID NOS: 2-15. The targeting moiety may comprise a humanized light chain and a humanized heavy chain of the FMC63 antibody (SEQ ID NO: 15). For example, the targeting moiety may comprise a humanized light chain comprising or consisting of an amino acid sequence of an one of SEQ ID NOS: 17-24 or any one of SEQ ID NOS: 27-34 and the targeting moiety may comprise a humanized heavy chain comprising or consisting of an amino acid sequence of an one of SEQ ID NOS: 2-14.

Humanization

Numerous methods for humanization are known in the art and are acceptable for making the humanized antibodies (e.g., humanized anti-CD19 antibodies, or antigen binding fragments or portions thereof) comprised in the CAR-EC switches disclosed herein. There are four general steps to humanize a monoclonal antibody. These are: (1) determining the nucleotide and predicted amino acid sequence of the starting antibody light and heavy variable domains; (2) designing the humanized antibody, i.e., deciding which antibody framework region to use during the humanizing process; (3) the actual humanizing methodologies/techniques; and (4) the transfection and expression of the humanized antibody. See, for example, U.S. Pat. Nos. 4,816,567; 5,807,715; 5,866,692; 6,331,415; 5,530,101; 5,693,761; 5,693,762; 5,585,089; and 6,180,370.

A number of "humanized" antibody molecules comprising an antigen-binding site derived from a non-human immunoglobulin have been described, including chimeric antibodies having rodent or modified rodent V regions and their associated CDRs fused to human constant domains. See, for example, Winter et al., 1991, Nature 349:293-299; Lobuglio et al., 1989, Proc. Nat. Acad. Sci. USA 86:4220-4224; Shaw et al., 1987, J Immunol. 138:4534-4538; and Brown et al., 1987, Cancer Res. 47:3577-3583. Other references describe rodent CDRs grafted into a human supporting framework region (FR) prior to fusion with an appropriate human antibody constant domain. See, for example, Riechmann et al., 1988, Nature 332:323-327; Verhoeyen et al., 1988, Science 239:1534-1536; and Jones et al., 1986, Nature 321:522-525. Another reference describes rodent CDRs supported by recombinantly engineered rodent framework regions. See, for example, European Patent Publ. No. 0519596. These "humanized" molecules are designed to minimize unwanted immunological response toward rodent anti-human antibody molecules which limits the duration and effectiveness of therapeutic applications of those moieties in human recipients. For example, the antibody constant region can be engineered such that it is immunologically inert (e.g., does not trigger complement lysis). See, e.g., PCT Publ. No. WO99/58572; UK Patent Application No. 9809951.8. Other methods of humanizing antibodies that may also be utilized are disclosed by Daugherty et al., 1991, Nucl. Acids Res. 19:2471-2476 and in U.S. Pat. Nos. 6,180,377; 6,054,297; 5,997,867; 5,866,692; 6,210,671; and 6,350,861; and in PCT Publ. No. WO 01/27160.

In yet another alternative, fully human antibodies may be obtained by using commercially available mice that have been engineered to express specific human immunoglobulin proteins. Transgenic animals that are designed to produce a more desirable or more robust immune response may also be used for generation of humanized or human antibodies. Examples of such technology are Xenomouse™ from Abgenix, Inc. (Fremont, Calif.), HuMAb-Mouse® and TC Mouse™ from Medarex, Inc. (Princeton, N.J.), and the VelocImmune® mouse from Regeneron Pharmaceuticals, Inc. (Tarrytown, N.Y.).

In an alternative, antibodies may be made recombinantly and expressed using any method known in the art. In another alternative, antibodies may be made recombinantly by phage display technology. See, for example, U.S. Pat. Nos. 5,565,332; 5,580,717; 5,733,743; and 6,265,150; and Winter et al., 1994, Annu. Rev. Immunol. 12:433-455. Alternatively, the phage display technology (McCafferty et al., 1990, Nature 348:552-553) can be used to produce human antibodies and antibody fragments in vitro, from immunoglobulin variable (V) domain gene repertoires from unimmunized donors. According to this technique, antibody V domain genes are cloned in-frame into either a major or minor coat protein gene of a filamentous bacteriophage, such as M13 or fd, and displayed as functional antibody fragments on the surface of the phage particle. Because the filamentous particle contains a single-stranded DNA copy of the phage genome, selections based on the functional properties of the antibody also result in selection of the gene encoding the antibody exhibiting those properties. Thus, the phage mimics some of the properties of the B cell. Phage display can be performed in a variety of formats; see, e.g., Johnson, Kevin S, and Chiswell, David J., 1993, Current Opinion in Structural Biology 3:564-571. Several sources of V-gene segments can be used for phage display. Clackson et al., 1991, Nature 352:624-628 isolated a diverse array of anti-oxazolone antibodies from a small random combinatorial library of V genes derived from the spleens of immunized mice. A repertoire of V genes from unimmunized human donors can be constructed and antibodies to a diverse array of antigens (including self-antigens) can be isolated essentially following the techniques described by Mark et al., 1991, J. Mol. Biol. 222:581-597, or Griffith et al., 1993, EMBO J. 12:725-734. In a natural immune response, antibody genes accumulate mutations at a high rate (somatic hypermutation). Some of the changes introduced will confer higher affinity, and B cells displaying high-affinity surface immunoglobulin are preferentially replicated and differentiated during subsequent antigen challenge. This natural process can be mimicked by employing the technique known as "chain shuffling." (Marks et al., 1992, Bio/Technol. 10:779-783). In this method, the affinity of "primary" human antibodies obtained by phage display can be improved by sequentially replacing the heavy and light chain V region genes with repertoires of naturally occurring variants (repertoires) of V domain genes obtained from unimmunized donors. This technique allows the production of antibodies and antibody fragments with affinities in the pM-nM range. A strategy for making very large phage antibody repertoires (also known as "the mother-of-all libraries") has been described by Waterhouse et al., 1993, Nucl. Acids Res. 21:2265-2266. Gene shuffling can also be used to derive human antibodies from rodent antibodies, where the human antibody has similar affinities and specificities to the starting rodent antibody. According to this method, which is also referred to as "epitope imprinting", the heavy or light chain V domain gene of rodent antibodies obtained by phage display technique is replaced with a repertoire of human V domain genes, creating rodent-human chimeras. Selection on antigen results in isolation of human variable regions capable of restoring a functional antigen-binding site, i.e., the epitope governs (imprints) the choice of partner. When the process is repeated in order to replace the remaining rodent V domain, a human antibody is obtained (see PCT Publ. No. WO 93/06213). Unlike traditional humanization of rodent antibodies by CDR grafting, this technique provides completely human antibodies, which have no framework or CDR residues of rodent origin.

In particular embodiments, an antibody, (e.g., an anti-CD19 antibody) is humanized according to the method described herein in Example 1. Briefly, in this non-limiting example, the FMC63 amino acid sequence was compared to murine and human germline sequences using IgBLAST (NCBI) and mutations of framework differences between the murine FMC63 VH and VL domains as compared to the VH and VL domains in human IGHV4-59 were made in the FMC63 sequence to render the sequence more identical to the human germline sequence. This process resulted in the production of several humanized heavy chain sequences (Table 3) and light chain sequences (Table 4), which were then modified into CAR-EC switches via the addition of a CAR-ID as an N-terminal fusion to the VL. The humanized switches comprising various pairs of humanized heavy and light chain sequences were tested for CD19 binding affinity and for efficacy for inducing cytotoxicity of CD19-expressing cells, as described in Examples 3 and 4, respectively.

Linkers

The switches disclosed herein may comprise one or more linkers. A linker may provide a switch flexibility, length or geometry optimal for facilitating an interaction or effect of the effector cell on the target cell. The switches disclosed herein may comprise two or more linkers. The switches disclosed herein may comprise three or more linkers. The switches disclosed herein may comprise four or more linkers. The switches disclosed herein may comprise 5, 6, 7, 8, 9, 10 or more linkers. The two or more linkers may be the same. At least two of the three or more linkers may be the same. The two or more linkers may be different. At least two of the three or more linkers may be different.

The linker may comprise a peptide. The linker may comprise a rigid peptide (such as EAAAKEAAAKEAAAKA (SEQ ID NO. 163)). The linker may comprise a flexible peptide such as GGGGS (SEQ ID NO. 93, n=1). The linker may comprise a sequence selected from SEQ ID NOS: 93-103, 116-137, and 163. Flexible and rigid linkers are understood by a person of skill in the art and are described in Chen et al. (Adv Drug Deliv Rev. 2013 65: 1357-1369, incorporated by reference herein in its entirety). Switch linker design may be critical to the expression yields and the potency of the switch. The linker may connect the CAR-ID to the targeting antibody sequence by fusion and grafting. Design of the linker may directly impact the stability (e.g., thermal stability, proteolytic stability) of the switch. The linker may further dictate how the peptide is presented to the CAR, especially in the distance and relative orientation to the switch. For example, a flexible linker may present many different orientations, while a rigid linker may form an alpha helix and present only one orientation of the peptide epitope relative to the antibody.

The linker may be at least about 1, at least about 2, at least about 3, at least about 4, at least about 5, at least about 6, at least about 7, at least about 8, at least about 9 or at least about 10 amino acids in length. The one or more linkers may comprise about 5, about 10, about 15, about 20, about 25, about 30, about 35, about 40, about 45, about 50, about 55, about 60, about 70, about 80, about 90 or about 100 amino acids.

The linker may be located at the N terminus or the C terminus of the CAR-ID (e.g., a polypeptide CAR-ID) to graft the CAR-ID to the targeting moiety. A first linker may be fused to the N terminus of the CAR-ID (e.g., a polypeptide CAR-ID) and a second linker may be fused to the C terminus of the CAR-ID. The CAR-ID may be grafted into an internal site of a targeting moiety with a linker on either end of the CAR-ID.

The linker may be located at the N terminus or the C terminus of the targeting moiety (e.g., an anti-CD19 antibody, or an antigen binding portion thereof) to graft the targeting moiety into the CAR-ID. A first linker may be fused to the N terminus of the targeting moiety and a second linker may be fused to the C terminus of the targeting moiety. The targeting moiety may be grafted into an internal site of the CAR-ID with a linker on either end of the targeting moiety.

The linker may be comprised of the sequence $(GGGGS)_n$, (SEQ ID NO:93), wherein n may be 1, 2, 3, 4, 5 or more. The linker may be comprised of the sequence $(GGS)_n$, (SEQ ID NO:95), wherein n may be 1, 2, 3, 4, 5 or more. The linker may comprise a sequence selected from SEQ ID NOS: 93-103. The linker may comprise the sequence GGGGS (SEQ ID NO: 93).

In some embodiments, the linker is fused to the targeting moiety. In some embodiments, the linker is fused to the CAR-ID. In some embodiments, the linker is fused to the CAR-ID and the targeting moiety. In some embodiments, the linker may be comprised of the sequence $(GGGGS)_n$, (SEQ ID NO:93), wherein n may be 1, 2, 3, 4, 5 or more, and where in the linker is fused to the CAR-ID, fused to the targeting moiety, or fused to both the CAR-ID and the targeting moiety.

The linker may be a bifunctional linker. The linker may be a heterobifunctional linker. The linker may be a homobifunctional linker. The linker may further comprise one or more polyethylene glycol (PEG) subunits. The linker may comprise at least four PEG subunits. The linker may comprise at least 10 PEG subunits. The linker may comprise at least 20 PEG subunits. The linker may comprise at least 30 PEG subunits. The linker may comprise an azide at one end. The linker may comprise an aminooxy at one end. The linker may be an azide-PEG-aminooxy linker. The linker may comprise cyclooctyne at one end. The linker may be a PEG-cyclooctyne linker. The linker may comprise triazole. The triazole may be a 1,2,3-triazole or a 1,2,4-triazole. The linker may be a NHS-ester linker. The linker may be a TriA linker. The linker may be attached to the CAR-ID. The linker may be attached to the CAR-ID by oxime ligation.

Some additional exemplary linkers and methods of constructing linkers can be found in WO2014/153002, which is incorporated herein by reference in its entirety.

The linker may be attached to a CAR-ID. The linker may be attached to a targeting moiety. The linker may attach a CAR-ID to a targeting moiety. The one or more linkers may attach the one or more CAR-IDs to the one or more targeting moieties. The one or more linkers may attach the one or more CAR-IDs to the one or more targeting moieties in a site-specific manner. Attachment in a site-specific manner may comprise attaching the one or more CAR-IDs to a predetermined site on the one or more targeting moieties. Alternatively, or additionally, attachment in a site-specific manner may comprise attaching the one or more CAR-IDs to an unnatural amino acid in the one or more targeting moieties. The one or more linkers may attach the one or more CAR-IDs to the one or more targeting moieties in a site-independent manner. Attachment in a site-independent manner may comprise attaching the one or more CAR-IDs to a random site on the one or more targeting moieties. The CAR-ID may be attached to 1, 2, 3, 4, 5 or more targeting moieties in a site-specific manner. The CAR-ID may be attached to 1, 2, 3, 4, 5 or more targeting moieties in a site-independent manner. Alternatively, the targeting moiety may be attached to 1, 2, 3, 4, 5 or more CAR-IDs in a site-specific manner. Attachment in a site-specific manner may comprise attaching the one or more targeting moieties to a predetermined site on the one or more CAR-IDs. The targeting moiety may be attached to 1, 2, 3, 4, 5 or more CAR-IDs in a site-independent manner. Attachment in a site-independent manner may comprise attaching the one or more targeting moieties to a random site on the one or more CAR-IDs.

The one or more linkers may be coupled to the CAR-ID, the targeting moiety, or a combination thereof. The one or more linkers may be coupled to the CAR-ID to form one or more switch intermediates of the Formula IIA: L1-X or Formula II: X-L1, wherein X is the CAR-ID and L1 is the linker. The one or more linkers may be coupled to the CAR-ID by an oxime. The one or more linkers may be coupled to the CAR-ID by a cyclooctyne, cyclopropene, aryl/alkyl azides, trans-cyclooctene, norborene, tetrazine, or a combination thereof. The one or more linkers may be coupled to the CAR-ID by a covalent bond, non-covalent bond, ionic bond, or a combination thereof. The one or more linkers may be coupled to the targeting moiety to form one or more switch intermediates of the Formula IIIA: L1-Y or Formula III: Y-L1, wherein Y is the targeting moiety and L1 is the linker. The one or more linkers may be coupled to the targeting moiety by an oxime. The one or more linkers may be coupled to the targeting moiety by a cyclooctyne, cyclopropene, aryl/alkyl azides, trans-cyclooctene, norborene, tetrazine, or a combination thereof. The one or more linkers may be coupled to the targeting moiety by a covalent bond, non-covalent bond, ionic bond, or a combination thereof.

The targeting moiety may comprise one or more amino acids. The one or more amino acids may comprise a natural amino acid. The linker may couple with one or more natural amino acids on the targeting moiety. The one or more amino acids may comprise one or more unnatural amino acids. The linker may couple with one or more unnatural amino acids on the targeting moiety. The linker may couple with an amino acid which is the product of site-specific mutagenesis. The linker may couple with a cysteine which is the product of site-specific mutagenesis. The linker (e.g., substituted maleimide) may couple with a cysteine which is the product of site-specific mutagenesis, as well as a native cysteine residue. Two linkers, each with complementary reactive functional groups, may couple with one another.

The one or more linkers may be a cleavable linker. The one or more linkers may be a non-cleavable linker. The one or more linkers may be a flexible linker. The one or more linkers may be an inflexible linker. The linker may be a bifunctional linker. A bifunctional linker may comprise a first functional group on one end and a second functional group on the second end. The bifunctional linker may be heterobifunctional linker. A heterobifunctional linker may comprise a first functional group on one end and a second functional group on the second end, wherein the first functional group and the second functional group are different. The bifunctional linker may be a homobifunctional linker. A homobifunctional linker may comprise a first functional group on one end and a second functional group on the second end, wherein the first functional group and the second functional group are the same.

The linker may comprise a chemical bond. The linker may comprise a functional group. The linker may comprise a polymer. The polymer may be a polyethylene glycol. The linker may comprise an amino acid.

The linker may comprise one or more functional groups. The linker may comprise two or more functional groups. The linker may comprise three or more functional groups. The linker may comprise four or more functional groups. The linker may comprise 5, 6, 7, 8, 9, 10 or more functional groups. The linker may be a bifunctional ethylene glycol linker.

The linker may comprise ethylene glycol. The linker may comprise about 1, about 2, about 3, about 4, about 5, about 6, about 7, about 8, about 9, about 10, about 11, about 12, about 13, about 14, about 15, about 16, about 17, about 18, about 19 or about 20 or more ethylene glycol subunits. The linker may comprise 4 or more ethylene glycol subunits. The linker may comprise 8 or more ethylene glycol subunits. The linker may comprise 10 or more ethylene glycol subunits. The linker may comprise 12 or more ethylene glycol subunits. The linker may comprise 15 or more ethylene glycol subunits. The linker may comprise 20 or more ethylene glycol subunits. The linker may comprise 25 or more ethylene glycol subunits. The linker may comprise 30 or more ethylene glycol subunits. The linker may comprise 35 or more ethylene glycol subunits.

The linker may comprise PEG. The linker may comprise about 1, about 2, about 3, about 4, about 5, about 6, about 7, about 8, about 9, about 10, about 11, about 12, about 13, about 14, about 15, about 16, about 17, about 18, about 19 or about 20 or more polyethylene glycol (PEG) subunits. The linker may comprise 4 or more polyethylene glycol (PEG) subunits. The linker may comprise 8 or more PEG subunits. The linker may comprise 10 or more PEG subunits. The linker may comprise 12 or more PEG subunits. The linker may comprise 15 or more PEG subunits. The linker may comprise 20 or more PEG subunits. The linker may comprise 25 or more PEG subunits. The linker may comprise 30 or more PEG subunits. The linker may comprise 35 or more PEG subunits.

The linker may comprise a triazole. The triazole may be a 1,2,3-triazole. The triazole may be a 1,2,4-triazole.

The linker may comprise an aryl or a heteroaryl. The linker may comprise an aryl. The aryl may be phenyl. The phenyl may be disubstituted. The disubstituted phenyl may be 1,4-disubstituted phenyl. The disubstituted phenyl may be 1,3-disubstituted phenyl. The phenyl may be trisubstituted. The phenyl may be tetrasubstituted. Two of the substituents of the substituted phenyl may be NO2. In some instances, the linker does not comprise a benzyl substituent.

The linker may comprise one or more PEG units. The linker may comprise multiple PEG units. The linker may comprise 2 or more PEG units. The linker may comprise 3 or more PEG units. The linker may comprise 4 or more PEG units. The linker may comprise 5 or more PEG units. The linker may comprise 6 or more PEG units. The linker may comprise 7 or more PEG units. The linker may comprise 8 or more PEG units. The linker may comprise 9 or more PEG units. The linker may comprise 10 or more PEG units. The linker may comprise 11 or more PEG units. The linker may comprise 12 or more PEG units. The linker may comprise 13 or more PEG units. The linker may comprise 14 or more PEG units.

The linker may comprise an amide on one end. The linker may comprise an amide on one end and an amine on the other end. The linker may comprise an amide on one end and a triazole on the other end.

The one or more linkers may comprise a 1,4-dicarboxylic moiety. The one or more linkers may comprise a 1,3-dinitro substituted phenyl moiety.

The one or more linkers may comprise one or more reactive functional groups. The reactive functional group may react with a complementary reactive functional group on a coupling partner. The reaction of the reactive functional group on the linker to a complementary reactive functional group on a coupling partner may occur prior to incorporation of the linker into the CAR-EC switch.

The linker may comprise at least one reactive functional group selected from alkoxy-amine, hydrazine, aryl/alkyl azide, alkyne, alkene, tetrazine, dichlorotriazine, tresylate, succinimidyl carbonate, benzotriazole carbonate, nitrophenyl carbonate, trichlorophenyl carbonate, carbonylimidazole, succinimidyl succinate, maleimide, vinylsulfone, haloacetamide, and disulfide. The alkene may be selected from norbornene, trans-cyclooctene, and cyclopropene. The linker may comprise at least one alkoxy amine. The linker may comprise at least one azide. The linker may comprise at least one cyclooctyne. The linker may comprise at least one tetrazine.

The one or more linkers may comprise an alkoxy-amine (or aminooxy) group, azide group and/or cyclooctyne group at one or more termini. The one or more linkers may comprise an alkoxy-amine at one terminus and an azide group at the other terminus. The one or more linkers may comprise an alkoxy-amine at one terminus and a cyclooctyne group at the other terminus. The alkoxy-amine may form a stable oxime with a ketone group on an amino acid. The alkoxy-amine may form a stable oxime with a ketone group on an unnatural amino acid. The ketone group may be on a p-acetyl phenylalanine (pAcF).

One or more linkers may be formed by reaction of reactive functional group on the CAR-ID with a complementary reactive functional group of a linker that is attached to the targeting moiety. One or more linkers may be formed by reaction of an amino acid or another reactive functional group on the targeting moiety with a complementary reactive functional group of a linker that is attached to the CAR-ID. One or more linkers may be formed by reaction of a linker that is attached to the CAR-ID with another linker that is attached to the targeting moiety.

The linker may be the product of a bioorthogonal reaction. For example, amino acids that contain ketone, azide, alkyne, alkene, and tetrazine side chains can be genetically encoded in response to nonsense and frameshift codons. These side chains can act as chemical handles for bioorthogonal conjugation reactions (Kim et al., Curr Opin Chem Bio 17:412-419 (2013), which is incorporated by reference in its entirety). The linker may comprise an oxime, a tetrazole, a Diels Alder adduct, a hetero Diels Alder adduct, an aromatic substitution reaction product, a nucleophilic substitution reaction product, an ester, an amide, a carbamate, an ether, a thioether, or a Michael reaction product. The linker may be a cycloaddition product, a metathesis reaction product, a metal-mediated cross-coupling reaction product, a radical polymerization product, an oxidative coupling product, an acyl-transfer reaction product, or a photo click reaction product. The cycloaddition may be a Huisgen-cycloaddition. The cycloaddition may be a copper-free [3+2] Huisgen-cycloaddition. The cycloaddition may be a Diels-Alder reaction. The cycloaddition may be a hetero Diels-Alder reaction. The linker may be the product of an enzyme-mediated reaction. The linker may be a product of a transglutaminase-mediated reaction, non-limiting examples of which are described in Lin et al., J. Am. Chem. Soc. 128:4542-4543 (2006) and WO 2013/093809. The linker may comprise a disulfide bridge that connects two cysteine residues, such as ThioBridge™ technology by PolyTherics. The linker may comprise a maleimide bridge that connects two amino acid residues. The linker may comprise a maleimide bridge that connects two cysteine residues.

Two or more linkers may be linked. The two or more linkers may be linked through one or more copper-free reactions. The two or more linkers may be linked through one or more cycloadditions. The two or more linkers may be linked through one or more Huisgen-cycloadditions. The two or more linkers may be linked through one or more copper-free [3+2] Huisgen-cycloadditions. The two or more linkers may be linked through one or more copper-containing reactions. The two or more linkers may be linked through one or more Diels Alder reactions. The two or more linkers may be linked through one or more hetero Diels Alder reactions.

Humanized CAR-EC switches may be optimized as disclosed in PCT/US2016/027997 and PCT/US2016/027990, each of which is incorporated herein by reference in its entirety. For example, humanized CAR-EC switches may be optimized by adjusting linker length. humanized CAR-EC switches may comprise linkers of different lengths. Linkers may be relatively short. Linkers may be relatively long. The one or more linkers may be between about 1 angstroms (Å) to about 120 Å in length. The one or more linkers may be between about 5 Å to about 105 Å in length. The one or more linkers may be between about 10 Å to about 100 Å in length. The one or more linkers may be between about 10 Å to about 90 Å in length. The one or more linkers may be between about 10 Å to about 80 Å in length. The one or more linkers may be between about 10 Å to about 70 Å in length. The one or more linkers may be between about 15 Å to about 45 Å in length. The one or more linkers may be equal to or greater than about 4, 5, 6, 7, 8, 9, 10, 11, 12, 13, 14, 15, 16, 17, 18, 19, 20, 25, 27, 30 or more angstroms in length. The one or more linkers may be equal to or greater than about 10 Å in length. The one or more linkers may be equal to or greater than about 15 angstroms in Å. The one or more linkers may be equal to or greater than about 20 Å in length. The one or more linkers may be equal to or less than about 110, 100, 90, 85, 80, 75, 70, 65, 60, 55, 50, 45, 43, 42, 41, 40, 39, 38, 37, 36, 35, 34, 33, 32, 31, 30 or fewer Å in length. The one or more linkers may be equal to or less than about 100 Å in length. The one or more linkers may be equal to or less than about 80 Å in length. The one or more linkers may be equal to or less than about 60 Å in length. The one or more linkers may be equal to or less than about 40 Å in length.

The total length of the linkers may be between about 1 Å to about 120 Å. The total length of the linkers may be between about 5 Å to about 105 Å. The total length of the linkers may be between about 10 Å to about 100 Å. The total length of the linkers may be between about 10 Å to about 90 Å. The total length of the linkers may be between about 10 Å to about 80 Å. The total length of the linkers may be between about 10 Å to about 70 Å. The total length of the linkers may be between about 15 Å to about 45 Å. The total length of the linkers may be equal to or greater than about 4, 5, 6, 7, 8, 9, 10, 11, 12, 13, 14, 15, 16, 17, 18, 19, 20, 25, 27, 30 or more A. The total length of the linkers may be equal to or greater than about 10 Å. The total length of the linkers may be equal to or greater than about 15 Å. The total length of the linkers may be equal to or greater than about 20 Å. The total length of the linkers may be equal to or less than about 110, 100, 90, 85, 80, 75, 70, 65, 60, 55, 50, 45, 43, 42, 41, 40, 39, 38, 37, 36, 35, 34, 33, 32, 31, 30 or fewer A. The total length of the linkers may be equal to or less than about 100 Å. The total length of the linkers may be equal to or less than about 80 Å. The total length of the linkers may be equal to or less than about 60 Å. The total length of the linkers may be equal to or less than about 40 Å. The total length of the linkers may be equal to or less than about 25 Å. The distance between the CAR-ID and the targeting moiety may be about 30 Å.

Grafted/Fused Switches

Disclosed herein are switches, wherein the CAR-ID is grafted or fused to the targeting moiety. The CAR-ID may comprise a non-antibody protein or a non-antibody peptide and the targeting moiety may bind to a cell surface molecule on a target. The cell surface molecule may comprise an antigen. The targeting moiety may be a targeting polypeptide. The targeting polypeptide may be a targeting antibody or antibody fragment. The antibody fragment may be an antigen binding portion of an antibody. The targeting antibody or antibody fragment may be an immunoglobulin (Ig). The immunoglobulin may be selected from an IgG, an IgA, an IgD, an IgE, an IgM, a fragment thereof or a modification thereof. The targeting antibody may bind a target on the cell surface of a target cell. In some embodiments, the target may be selected from CD19, Her2, CLL1, CD33, CD123, EGFR, EGFRvIII, CD20, CD22, CS1, BCMA, and CEA. In some embodiments, the disclosure presents a humanized targeting moiety grafted with the CAR-ID. In some embodiments, the targeting moiety is an anti-CD19 targeting antibody or a CD19-binding fragment there. In some embodiments, the targeting moiety is a humanized anti-CD19 targeting antibody or a CD19-binding fragment thereof. The targeting antibody or antibody fragment may be selected from an immunoglobulin, a Fab, a Fab', a F(ab')$_2$ and an scFv. The targeting antibody or antibody fragment may comprise a light chain. The targeting antibody or antibody fragment may comprise a heavy chain.

The CAR-ID may be grafted into the targeting moiety (e.g., between chosen amino acids of the targeting antibody or antibody fragment). The CAR-ID may be fused to a terminus of the targeting antibody or antibody fragment. Alternatively, the targeting antibody or antibody fragment may be grafted into or fused to the CAR-ID.

The CAR-ID may be fused to an N terminus of the light chain of the targeting antibody or antibody fragment. The CAR-ID may be fused to a C terminus of the light chain of the targeting antibody or antibody fragment. The CAR-ID may be fused to an N terminus of the heavy chain of the targeting antibody or antibody fragment. The CAR-ID may be fused to a C terminus of the heavy chain of the targeting antibody or antibody fragment. The CAR-ID may be fused to an N terminus of a VL domain of the targeting antibody or antibody fragment. The CAR-ID may be fused to an N terminus of a VH domain of the targeting antibody or antibody fragment. The CAR-ID may be fused to a C terminus of a CL domain of the targeting antibody or antibody fragment. The CAR-ID may be fused to a C terminus of an Fc domain of the targeting antibody or antibody fragment. The CAR-ID may be fused to an N terminus of a VL domain of an IgG. The CAR-ID may be fused to an N terminus of a VH domain of an IgG. The CAR-ID may be fused to a C terminus of a CL domain of an IgG. The CAR-ID may be fused to a C terminus of an Fc domain of an IgG. The CAR-ID may be fused to an N terminus of a VL domain of a Fab. The CAR-ID may be fused to an N terminus of a VH domain of a Fab. The CAR-ID may be fused to a C terminus of a CL domain of a Fab. The CAR-ID may be fused to a C terminus of a CH$_1$ domain of the Fab.

The CAR-ID may be grafted into an internal site of the targeting moiety (e.g., an anti-CD19 targeting antibody or CD19-binding antibody fragment (e.g., between chosen amino acids of the targeting antibody or antibody fragment)). The CAR-ID may be grafted into a heavy chain of a targeting antibody or antibody fragment. The CAR-ID may be grafted into a light chain of a targeting antibody or antibody fragment. The CAR-ID may be grafted into a constant domain/region of a targeting antibody or antibody fragment. The CAR-ID may be grafted into a variable domain/region of a targeting antibody or antibody fragment. The CAR-ID may be grafted into an internal site of a Fab. The CAR-ID may be grafted into an internal site of an immunoglobulin (e.g., IgG). The CAR-ID may be grafted into a domain of the targeting antibody or fragment thereof selected from a CL domain, a CH$_1$ domain, a CH$_2$ domain, a CH$_3$ domain, a VL domain, a VH domain and a hinge domain. The CAR-ID may be grafted between two domains of the antibody or fragment thereof selected from a CL domain, a CH$_1$ domain, a CH$_2$ domain, a CH$_3$ domain, a VL domain, a VH domain and a hinge domain, wherein the two domains are adjacent. The CAR-ID may be grafted into a CL domain of the antibody or fragment thereof. The CAR-ID may be grafted into a CH$_1$ domain of the antibody or fragment thereof. The CAR-ID may be grafted into a hinge domain of the antibody or fragment thereof. The CAR-ID may be grafted into a loop of the antibody or fragment thereof. The CAR-ID may be grafted into a CL domain loop of the antibody or fragment thereof.

The CAR-ID may be grafted into the C terminus of the targeting moiety (e.g., a humanized anti-CD19 targeting antibody or CD19-binding antibody fragment) and therefore the distance between the chimeric receptor and the target may differ substantially depending on the size of chimeric receptor-EC switch (approximately 40 Å for scFv, 70 Å for Fab, and 120 Å for IgG). While a larger distance may negatively impact efficacy in vitro, the increased residence time of the full length antibody may be superior in vivo.

Multivalent Switches

Exemplified herein are switches comprising a CAR-ID and a humanized CD19-binding targeting moiety. Also exemplified herein are switches comprising a GCN4 peptide derivative and a targeting moiety (e.g., a CD19 targeting moiety). However, one skilled in the art will understand from the disclosure that the switches disclosed herein further comprise additional or alternative targeting moieties and/or additional or alternative CAR-IDs. One or more CAR-IDs may be grafted into one or more grafting sites of the targeting moiety, and vice versa. One or more CAR-IDs may be fused to one or more termini of the targeting moiety, and vice versa. One or more CAR-IDs may be conjugated to one or more termini of the targeting moiety, and vice versa. This may be advantageous, as several grafting/fusing sites may be predicted to provide optimal binding of the CAR-ID to the chimeric receptor. For example, a first CAR-ID may be grafted into a first domain of the targeting moiety and a second CAR-ID may be grafted into a second domain of the targeting moiety. The first domain and the second domain may be the same. The first domain and the second domain may be different. By way of non-limiting example, the first CAR-ID may be grafted into a light chain of a targeting antibody or antibody fragment and a second CAR-ID may be grafted into heavy chain of the targeting antibody or antibody fragment. The first CAR-ID may be fused to a first terminus of the targeting polypeptide and a second CAR-ID may be fused to a second terminus of the targeting polypeptide. By way of non-limiting example, the first CAR-ID may be fused to a C terminus of a light chain of a targeting antibody or antibody fragment and a second CAR-ID may be fused to an N terminus of a heavy chain of the targeting antibody or antibody fragment. The first CAR-ID may be fused to a terminus of the targeting polypeptide and a second CAR-ID may be grafted within a domain of the targeting polypeptide. The first CAR-ID and the second CAR-ID may be the same or similar, such that the switch may be used with an effector cell that expresses one chimeric receptor. The first CAR-ID and the second CAR-ID may be different, such that the switch may be used with an effector cell that expresses one or more chimeric receptors or multiple effector cells that express different chimeric receptors.

The switches disclosed herein may comprise one or more CAR-IDs. The switches disclosed herein may comprise two or more CAR-IDs. The switches disclosed herein may comprise three or more CAR-IDs. The switches disclosed herein may comprise 1, 2, 3, 4, 5, 6, 7 or more CAR-IDs. The one or more CAR-IDs may be fused or grafted to the targeting moiety via one or more linkers. Thus, the switches disclosed herein may comprise one or more linkers. The switches disclosed herein may comprise two or more linkers. The switches disclosed herein may comprise three or more linkers. The switches disclosed herein may comprise 1, 2, 3, 4, 5, 6, 7 or more linkers.

II. CAR-EC Switch Production Methods

Disclosed herein are methods of producing humanized CAR-EC switches.

In some embodiments, the methods comprise expressing one or more polypeptides from one or more vectors comprising one or more polynucleotide having one or more sequences that encode a chimeric antigen receptor-effector cell switch or a portion thereof, wherein the chimeric antigen receptor-effector cell switch comprises a CAR-ID and an anti-target targeting moiety.

In some embodiments, the methods comprise expressing one or more polypeptides from one or more vectors comprising one or more polynucleotide having one or more sequences that encode a chimeric antigen receptor-effector cell switch or a portion thereof, wherein the chimeric antigen receptor-effector cell switch comprises a CAR-ID and a humanized anti-CD19 targeting moiety.

In some embodiments, the methods comprise expressing one or more polypeptides from one or more vectors comprising one or more polynucleotide having one or more sequences that encode a chimeric antigen receptor-effector cell switch or a portion thereof, wherein the chimeric antigen receptor-effector cell switch comprises a GCN4 peptide derivative disclosed herein and a targeting moiety. In some embodiments, the targeting moiety is humanized. In some embodiments, the targeting moiety targets CD19. In some particular embodiments, the targeting moiety is a humanized anti-CD19 targeting moiety.

The targeting moiety may comprise a targeting polypeptide (e.g., a humanized anti-CD19 antibody or a CD19-binding fragment of a humanized anti-CD19 antibody). In general, such methods comprise fusing or grafting a polynucleotide encoding the CAR-ID to a polynucleotide encoding a targeting moiety (e.g., a humanized anti-CD19 polypeptide targeting moiety (targeting polypeptide)). Fusing or grafting may be carried out by any standard cloning method known to one skilled in the art. Fusing or grafting the polynucleotides encoding the CAR-ID (e.g., a GCN4 peptide derivative) and targeting polypeptide (e.g., an antibody such as a CD19 antibody or an antigen binding portion thereof) may comprise enzymatic digestion of the polynucleotides, ligation of the polynucleotides and/or amplification of the polynucleotides.

The CAR-ID may be fused to an N terminus of the targeting polypeptide. The CAR-ID may be fused to a C terminus of the targeting polypeptide. The CAR-ID may be grafted within the targeting polypeptide. The targeting polypeptide may comprise a targeting antibody or antibody fragment. The CAR-ID may be fused to an N terminus of the targeting antibody or antibody fragment. The CAR-ID may be fused to a C terminus of the targeting antibody or antibody fragment.

Figure 15:
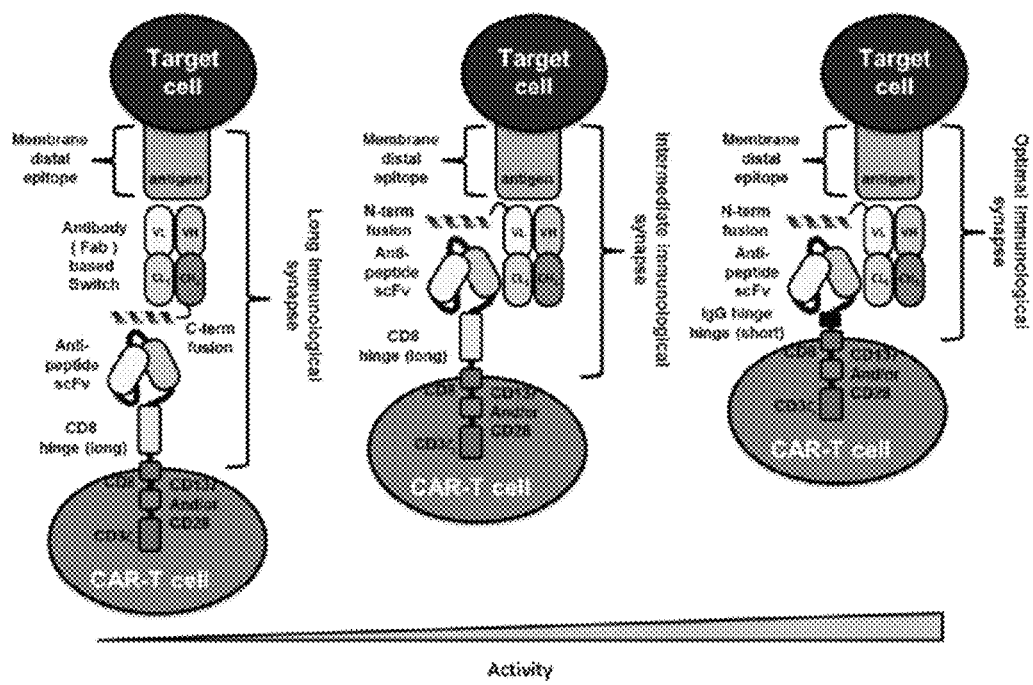
FIG. 15: exemplifies switch optimization for switchable CAR-T cells by varying the length of the immunological synapse from long (left) to intermediate (middle) to short (right), activity increasing from left to right.
Figure 16:
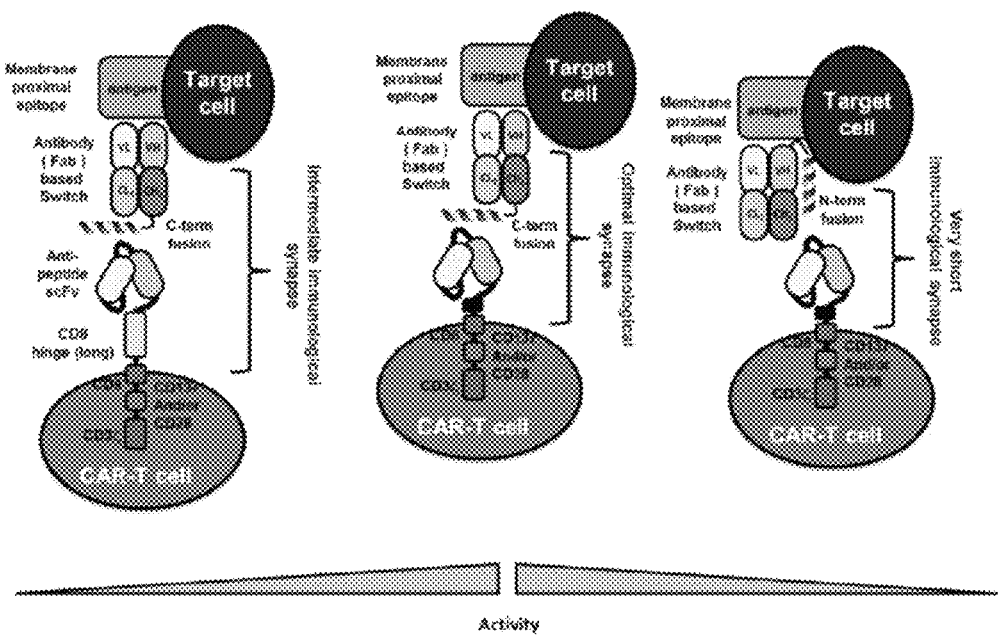
FIG. 16: exemplifies switch optimization for switchable CAR-T cells by varying the length of the immunological from intermediate (left) to short (middle) to very short (right), switch activity optimal with a short synapse, relative to switch activity produced with the intermediate synapse or very short synapse.
Figures 18, 19:
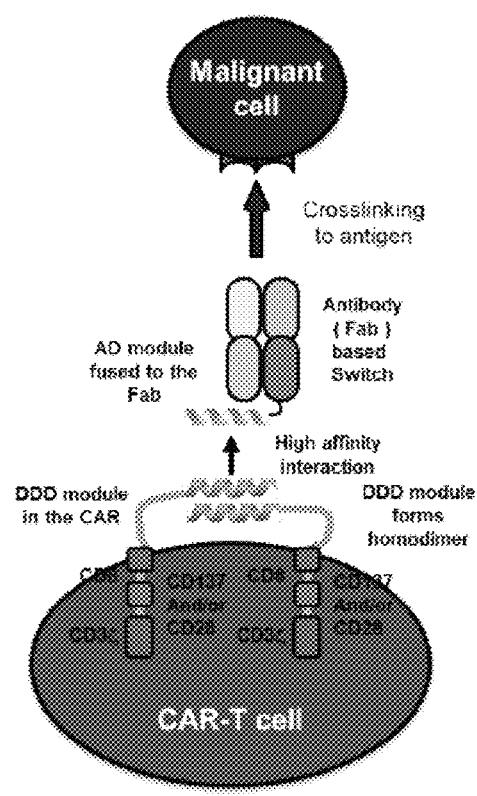
FIG. 18 illustrates an example of a dock and lock switchable chimeric receptor-T cell platform in which the DDD-module is on the chimeric receptor extracellular domain and the AD-module is on the switch.
FIG. 19 shows residue numbering on GCN4 peptide derivatives for reference with Example 6. The original peptide used for targeting is shown at the bottom colored by results of alanine scanning. Red indicates residue that is intolerant to alanine mutation (complete loss of binding to anti-GCN4 scFv 52SR4), orange indicates residue that is somewhat tolerant to alanine mutation (some loss of binding to anti-GCN4 scFv 52SR4, but still some level of binding), and green indicates residue that is completely tolerant to alanine mutation (no loss of binding to anti-GCN4 scFv 52SR4 compared with the original peptide sequence). Potential modifications to the sequence are listed on top. Residues 1-4 are part of the native GCN4 sequence, included in the previously reported development of the 52SR4 antibody. Yellow indicates a new residue not explored before as a target of the CAR-EC. Blue indicates preferred residue addition or modification based on both the extended residues and the alanine scanning. This schematic was used to design modified peptides A-O.

In some embodiments, the design of the switch (e.g., grafting position of the CAR-ID on a targeting moiety, length of a linker connecting the CAR-ID to the targeting moiety, etc.) is critical to the cytotoxicity, activation, and cytokine release of the peptide switchable CAR-EC cells. The switch grafting position may be empirically designed for the target based on the epitope location of an anti-target antibody (targeting moiety) on the target in order to find an optimal distance and geometry (immunological synapse) between the CAR-EC and the target cell. For example, in some embodiments, for antibodies that bind to CD19 epitopes that are far from the membrane (membrane distal), switch designs that provide an overall short immunological synapse through the use of an N-terminal fusion of the CAR-ID on an anti-CD19 targeting moiety (e.g., an anti-CD19 antibody or antigen binding portion thereof, such as any one of the humanized anti_CD19 antibodies disclosed herein) may improve the activity (FIG. 15 (middle)). Designs which provide too much distance between the CAR-EC and target cell through the use of a C-terminal fusion may result in suboptimal activity (FIG. 15 (left)). The CAR may also be modified to shorten the hinge region. This may bring the CAR-T cell and target cell closer together (FIG. 15 (right)) which is further advantageous. Also, by way of a non-limiting example, for antibodies that bind to epitopes of CD19 that are close the membrane (membrane proximal), switch designs that provides sufficient distance (through the use of a C-terminal fusion) for the immunological synapse to form are optimal (FIG. 16 (middle)). Designs which do not provide enough distance between the CAR-EC and the target cell through the use of N-terminal fusions may result in suboptimal or no activity due to steric hindrance (FIG. 16 (right)). Designs which provide too much distance between the CAR-EC and target cell (through a longer hinge region) may result in suboptimal activity (FIG. 16 (left)).

As will be clear to one skilled in the art, the sequences disclosed herein may include leader peptides (or "leader sequence", interchangeably), which will be cleaved during polypeptide expression if expression is in a cell comprising a secretory pathway. The location of the leader peptide is at the N-terminus of the protein, and the leader sequences are readily apparent to one skilled in the art and can be easily identified using, e.g., the SignalP server (available at the world wide web address: cbs.dtu.dk/services/SignalP/, incorporated herein by reference in its entirety). In one non-limiting embodiment, the leader peptide may comprise or consist of the kappa leader sequence (e.g., SEQ ID NO: 246).

The CAR-ID may be fused to the terminus of the targeting polypeptide without replacing or removing any amino acids of the targeting polypeptide. Fusing the CAR-ID to the terminus of the targeting polypeptide may comprise removing or replacing amino acids at the terminus of the targeting polypeptide. Removing or replacing amino acids at the terminus of the targeting polypeptide may comprise removing or replacing about 1 to about 20 amino acids at the terminus of the targeting polypeptide. The CAR-ID may be fused to the terminus of the targeting polypeptide via a linker. The linker may be fused to the CAR-ID to produce a CAR-ID-linker intermediate. The linker may be fused to a CAR-ID N terminus to produce the CAR-ID-linker intermediate. The linker may be fused to a CAR-ID C terminus to produce the CAR-ID-linker intermediate. The CAR-ID-linker intermediate may be fused to the targeting polypeptide. The CAR-ID-linker intermediate may be fused to the N terminus of the targeting polypeptide. The CAR-ID-linker intermediate may be fused to the C terminus of the targeting polypeptide. A first CAR-ID linker intermediate may be fused to the N terminus of the targeting polypeptide and a second CAR-ID linker intermediate may be fused to the C terminus of the targeting polypeptide. The CAR-ID of the first CAR-ID linker intermediate may be the same or similar to the CAR-ID of the second CAR-ID linker intermediate. The CAR-ID of the first CAR-ID linker intermediate may be different from the CAR-ID of the second CAR-ID linker intermediate.

As used herein, light chain grafts on the N-terminus may be referred to as LCNT. Light chain grafts on the C-terminus may be referred to as LCCT. Light chain grafts in the C1 domain may be referred to as LCC1. Heavy chain grafts on the N-terminus may be referred to as HCNT. Heavy chain grafts on the C-terminus may be referred to as HCCT. Heavy chain grafts in the C1 domain may be referred to as HCC1. Switches expressed with N-terminal grafts on the light and heavy chain may be referred to as NTBV. Switches expressed with C-terminal grafts on the light and heavy chain may be referred to as CTBV. Switches expressed with grafts in the C1 domain of the light and heavy chain may be referred to as C1BV.

As used herein, the term "grafted" may refer to inserting a CAR-ID within a targeting polypeptide (e.g., between two amino acids of the targeting polypeptide). The CAR-ID may be grafted within the targeting polypeptide without replacing or removing any amino acids of the targeting polypeptide. Grafting the CAR-ID within the targeting polypeptide may comprise removing or replacing amino acids within the targeting polypeptide. Removing or replacing amino acids within the targeting polypeptide may comprise removing or replacing about 1 to about 20 amino acids within the targeting polypeptide. The CAR-ID may be grafted within the targeting polypeptide via one linker. The CAR-ID may be grafted within the targeting polypeptide via two linkers. The linker may be fused to the CAR-ID N terminus to produce a CAR-ID-linker intermediate. The linker may be fused to the CAR-ID C terminus to produce a CAR-ID-linker intermediate. A first linker may be fused to the CAR-ID N terminus and a second linker may be fused to the CAR-ID C terminus to produce a CAR-ID-linker intermediate. The CAR-ID linker intermediate may be grafted within the targeting polypeptide. A first CAR-ID linker intermediate may be grafted within the targeting polypeptide and a second CAR-ID linker intermediate may be grafted within the targeting polypeptide. The first CAR-ID linker intermediate may be grafted within a first domain of the targeting polypeptide and a second CAR-ID linker intermediate may be grafted within a second domain of the targeting polypeptide. The first domain of the targeting polypeptide may be the same as the second domain of the targeting polypeptide. The first domain of the targeting polypeptide may be different from the second domain of the targeting polypeptide. The CAR-ID of the first CAR-ID linker intermediate may be the same or similar to the CAR-ID of the second CAR-ID linker intermediate. The CAR-ID of the first CAR-ID linker intermediate may be different from the CAR-ID of the second CAR-ID linker intermediate. Unless otherwise specified, the terms "graft" and "insert", as used herein, are used interchangeably.

The targeting moiety may bind to a target on the cell surface of a target cell. In some embodiments, the targeting moiety may comprise a humanized anti-CD19 antibody or a CD19 binding fragment thereof (e.g., any one or more of the humanized anti-CD19 antibodies or fragments thereof disclosed herein). The antibody or antibody fragment may comprise a heavy chain and a light chain or fragments thereof. The methods may comprise expressing a heavy chain wherein the CAR-ID is fused to a terminus of the heavy chain. The methods may comprise expressing a heavy chain wherein the CAR-ID is grafted within the heavy chain. The methods may comprise expressing a light chain wherein the CAR-ID is fused to a terminus of the light chain. The methods may comprise expressing a light chain wherein the CAR-ID is grafted within the light chain.

The methods may further comprise cloning one or more polynucleotides encoding the targeting polypeptide and/or the CAR-ID into an expression vector. The methods may further comprise ligation of the one or more polynucleotides encoding the targeting polypeptide and/or CAR-ID into an expression vector. The expression vector may be a prokaryotic expression vector. The expression vector may be a eukaryotic expression vector. The expression vector may be a mammalian expression vector. The expression vector may be a viral expression vector. The expression vector may be a pFUSE vector. The methods may further comprise validating the cloning of the one or more polynucleotides encoding the targeting polypeptide and/or CAR-ID into the expression vector comprising sequencing the expression vector, running gel electrophoresis of the vector and/or viewing the targeting polypeptide and/or CAR-ID on an SDS page gel.

The methods may further comprise amplifying a polynucleotide encoding the targeting polypeptide and/or CAR-ID and cloning the targeting polypeptide and/or CAR-ID into the expression vector. Amplifying the polynucleotide encoding the targeting polypeptide and/or the CAR-ID may comprise synthesizing oligonucleotides at least partially complementary to the gene. The oligonucleotides may be sufficiently complementary to the gene to anneal to the polynucleotide. The oligonucleotides may comprise linker sequences. Many suitable linkers are known in the art and are suitable for use in the present invention. In some embodiments, the linker is a linker disclosed herein. In some embodiments, the linker sequences may be selected from SEQ ID NOs: 93-103, 116-137, and 164-168.

The methods may comprise transfecting or infecting a cell with the expression vector. The methods may further comprise expressing the targeting polypeptide and/or CAR-ID in the cell. The methods may further comprise expressing the targeting polypeptide and/or CAR-ID in a cell free system. The methods may further comprise producing a virus comprising the expression vector. The methods may further comprise propagating the virus. The methods may further comprise infecting a cell with the virus comprising the expression vector. The methods may further comprise propagating the cell.

The switch may be expressed as two vectors, one of the heavy chain of the antibody and one for the light chain of the antibody. The two vectors may be co-transfected into an expression cell. The expression cell may be selected from a prokaryotic cell and a eukaryotic cell. The expression cell may be selected from a HEK cell and a CHO cell. Expression may be carried out in HEK cells over 7 or more days with routine harvesting of media to collect and isolate the antibody switch of interest. Expression may be carried out in less than 7 days. The switch may also be expressed from CHO cells in analogous fashion using the same plasmids. The media may or may not be harvested at intervals or may be harvested at the end of the expression. Harvesting at intervals may be preferable to preventing proteolytic degradation of the switch.

The switch may be expressed in *E. coli*. The switch may be expressed in *E. coli* from a vector, such as the pBAD vector, by way of non-limiting example. The pBAD vector may harbor both the light chain and the heavy chain of the antibody. This may require transformation of *E. coli* with only one plasmid. This may be advantageous as expression in *E. coli* is generally less expensive and faster than expression in mammalian cells (e.g., HEK cells). In some embodiments, switches expressed in *E. coli* may comprise modified CAR-IDs and/or modified targeting moieties in which dilysine motifs are eliminated to avoid cleave of the peptide by OmpT protease. In some embodiments, to express the switch in *E. coli*, careful attention is paid to the genotype of the strain used. In some embodiments, preferable genotypes include, but are not limited to, those with the ompT gene (an outer membrane protein protease VII which may proteolyze the expressed protein) disrupted. This includes BL21 (*E. coli* B F− dcm ompT hsdS(rB− mB−) gal [malB+]K-12(λS)), OverExpress™C41(DE3) (Lucigen) (F− ompT gal dcm hsdSB(rB− mB−)(DE3)), and others. The non-preferable strains for expression include DH10B (F− endA1 recA1 galE15 galK16 nupG rpsL ΔlacX74 Φ80lacZΔM15 araD139 Δ(ara,leu)7697 mcrA Δ(mrr-hsdRMS-mcrBC) λ−), DH5alpha (F− endA1 glnV44 thi-1 recA1 relA1 gyrA96 deoR nupG Φ80dlacZΔM15 Δ(lacZYA-argF)U169, hsdR17 (rK− mK+), λ−) or other strains which do not include the ompT knockout. Strains such as DH10B and DH5alpha may be made preferable by disruption of the ompT gene. Disclosed herein are methods of grafting the antibody or antibody fragment, the CAR-ID or the targeting peptide to produce a CAR-EC switch. The method may comprise grafting the CAR-ID to the antibody or antibody fragment. The method may comprise grafting the CAR-ID to an N terminus, C terminus or internal site of the antibody or antibody fragment. The CAR-ID may be grafted to a CL domain of the antibody or antibody fragment. The CAR-ID may be grafted to a loop of the CL domain of the antibody or antibody fragment. The method may comprise grafting the antibody or antibody fragment to the CAR-ID. The method may comprise grafting the antibody or antibody fragment to an N terminus, C terminus or internal site of the CAR-ID. The method may comprise grafting the CAR-ID to the targeting peptide. The method may comprise grafting the CAR-ID to an N terminus, C terminus or internal site of the targeting peptide. The method may comprise grafting the targeting peptide to the CAR-ID. The method may comprise grafting the targeting peptide to an N terminus, C terminus or internal site of the CAR-ID.

The CAR-ID, targeting peptide, antibody or antibody fragment may comprise one or more linkers, wherein the linker is located at the N terminus and/or C terminus of the CAR-ID, targeting peptide, antibody or antibody fragment. The method may comprise grafting the antibody or antibody fragment, the CAR-ID or the targeting peptide through the linker. The linker may comprise $(GSSSS)_n$. The linker may comprise a sequence selected from SEQ ID NOs: 93-103, 116-137, and 164-168. The linker may comprise a sequence that is at least about 50% identical to a sequence selected from SEQ ID NOs: 93-103, 116-137, and 164-168. The linker may comprise a sequence selected from SEQ ID NOs: 93-103, 116-137, and 164-168.

Grafting may comprise producing a CAR-EC switch encoding nucleic acid. Producing the CAR-EC switch encoding nucleic acid may comprise one or more polymerase chain reactions. Producing the CAR-EC switch encoding nucleic acid may comprise one or more nucleic acid enzymatic digestions. The enzymatic digestion may be site-specific. Producing the CAR-EC switch encoding nucleic acid may comprise one or more ligations. The methods of producing the CAR-EC switch may comprise incorporating the CAR-EC switch encoding nucleic acid into a CAR-EC switch vector. The vector may be an expression vector. The expression vector may comprise a constitutive promoter, an inducible promoter and/or a conditional promoter. The CAR-EC switch encoding nucleic acid or CAR-EC switch vector may be expressed in a cell and the resulting CAR-EC switch isolated and purified. The cell may be a prokaryotic cell. The cell may be an *E. coli*. The cell may be a eukaryotic cell. The cell may be a mammalian cell. The CAR-EC switch encoding nucleic acid or CAR-EC switch vector may be expressed in a cell-free system. Alternatively or additionally the CAR-EC switch may be synthesized from free amino acids.

In some embodiments, the method comprises attaching a CAR-ID to a targeting moiety. In some embodiments, the method may comprise attaching a switch intermediate comprising a CAR-ID and a linker to a targeting moiety. The method may comprise attaching a switch intermediate comprising a targeting moiety and a linker to a CAR-ID. The method may comprise attaching a first switch intermediate comprising a CAR-ID and a first linker to a second switch comprising a targeting moiety and a second linker. Attachment of the CAR-ID to the targeting moiety may occur in a site-specific manner. Attachment in a site-specific manner may comprise attaching the CAR-ID to a predetermined site on the targeting moiety. Attachment in a site-specific manner may comprise attaching the targeting moiety to a predetermined site on the CAR-ID. Attachment of the CAR-ID to the targeting moiety may occur in a site-independent manner. Attachment in a site-independent manner may comprise attaching the CAR-ID to a random site on the targeting moiety. Attachment in a site-independent manner may comprise attaching the targeting moiety to a random site on the CAR-ID. The method may further comprise attaching one or more additional CAR-IDs to the targeting moiety. The method may further comprise attaching or more additional targeting moieties to the CAR-ID. The method may further comprise using one or more additional linkers to connect the targeting moiety to the CAR-ID. Attaching the CAR-ID to the targeting moiety may comprise conducting one or more chemical reactions.

The method of producing a switch may comprise linking a targeting moiety based on or derived from an antibody or antibody fragment to a CAR-ID or a switch intermediate comprising a CAR-ID to produce a CAR-EC switch comprising (a) the targeting moiety; (b) one or more linkers; and (c) the CAR-ID, the one or more linkers may link the targeting moiety to the CAR-ID. Linking the targeting moiety to the CAR-ID may occur in a site-specific manner. The CAR-ID may be attached to a predetermined site on the targeting moiety via the one or more linkers. The targeting moiety may be attached to a predetermined site on the CAR-ID via the one or more linkers.

The CAR-EC switches disclosed herein may comprise one or more unnatural amino acids. The one or more CAR-IDs may comprise one or more unnatural amino acids. The one or more targeting moieties may comprise one or more unnatural amino acids. The one or more linkers may comprise one or more unnatural amino acids. Attachment of the CAR-ID to the targeting moiety may occur via the one or more unnatural amino acids. The one or more linkers may link the one or more CAR-IDs to the one or more targeting moieties site-specifically through the one or more unnatural amino acids. Alternatively, or additionally, the one or more linkers may link the one or more targeting moieties to the one or more targeting moieties site-specifically, wherein an unnatural amino acid is not required to link the one or more targeting moieties to the one or more targeting moieties. The targeting moiety may be linked to 1, 2, 3, 4, 5 or more unnatural amino acids on the targeting moiety. The targeting moiety may be linked to 1, 2, 3, 4, 5 or more unnatural amino acids on the targeting moiety site-specifically. Alternatively, the targeting moiety may be linked to 1, 2, 3, 4, 5 or more unnatural amino acids on the targeting moiety. The targeting moiety may be linked to 1, 2, 3, 4, 5 or more unnatural amino acids on the targeting moiety site-specifically.

The CAR-ID may comprise one or more unnatural amino acids. The CAR-IDs disclosed herein may comprise 1, 2, 3, 4, 5, 6, 7, 8, 9, 10 or more unnatural amino acids. The targeting moiety may comprise one or more unnatural amino acids. The targeting antibodies or antibody fragments disclosed herein may comprise 2, 3, 4, 5, 6, 7, 8, 9, 10 or more unnatural amino acids. The unnatural amino acid may react with the linker to create a chemical bond.

The one or more unnatural amino acids may be inserted between two naturally occurring amino acids in the targeting moiety. The one or more unnatural amino acids may replace one or more naturally occurring amino acids in the targeting moiety. The one or more unnatural amino acids may be incorporated at the N terminus of the targeting moiety. The one or more unnatural amino acids may be incorporated at the C terminus of the targeting moiety. The one or more unnatural amino acids may be incorporated at an internal site of the targeting moiety. The unnatural amino acid may be incorporated distal to the region of the targeting moiety that interacts with a molecule on or from a target. The unnatural amino acid may be incorporated proximal to the region of the targeting moiety that interacts with a molecule on or from a target. The unnatural amino acid may be incorporated at a site intermediate to the region of the targeting moiety that interacts with a molecule on or from a target. The unnatural amino acid may be incorporated in the region of the targeting moiety that interacts with a molecule on or from a target.

The one or more unnatural amino acids may replace one or more amino acids in the targeting moiety. The one or more unnatural amino acids may replace any natural amino acid in the targeting moiety.

The one or more unnatural amino acids may be incorporated in a light chain of the immunoglobulin from which the targeting moiety is based or derived. The one or more unnatural amino acids may be incorporated in a heavy chain of the immunoglobulin from which the targeting moiety is based or derived. The one or more unnatural amino acids may be incorporated in a heavy chain and a light chain of the immunoglobulin from which the targeting moiety is based or derived. The one or more unnatural amino acids may replace an amino acid in the light chain of the immunoglobulin from which the targeting moiety is based or derived. The one or more unnatural amino acids may replace an amino acid in a heavy chain of the immunoglobulin from which the targeting moiety is based or derived. The one or more unnatural amino acids may replace an amino acid in a heavy chain and a light chain of the immunoglobulin from which the targeting moiety is based or derived.

The one or more unnatural amino acids may replace a glycine of a light chain of the immunoglobulin from which the targeting moiety is based or derived. The one or more unnatural amino acids may replace an arginine of a light chain of the immunoglobulin from which the targeting moiety is based or derived. The one or more unnatural amino acids may replace a serine of a light chain of the immunoglobulin from which the targeting moiety is based or derived. The one or more unnatural amino acids may replace a threonine of a light chain of the immunoglobulin from which the targeting moiety is based or derived. The one or more unnatural amino acids may replace an alanine of a light chain of the immunoglobulin from which the targeting moiety is based or derived. The one or more unnatural amino acids may replace an alanine of a heavy chain of the immunoglobulin from which the targeting moiety is based or derived. The one or more unnatural amino acids may replace a serine of a heavy chain of the immunoglobulin from which the targeting moiety is based or derived. The one or more unnatural amino acids may replace a lysine of a heavy chain of the immunoglobulin from which the targeting moiety is based or derived. The one or more unnatural amino acids may replace a proline of a heavy chain of the immunoglobulin from which the targeting moiety is based or derived.

In some embodiments, the one or more unnatural amino acids may replace an amino acid of the targeting moiety, wherein the targeting moiety is a humanized anti-CD19 antibody or a CD19-binding fragment thereof. The one or more unnatural amino acids may replace a glycine of a light chain of the anti-CD19 antibody or fragment thereof. The one or more unnatural amino acids may replace a threonine of a light chain of the anti-CD19 antibody or fragment thereof. The one or more unnatural amino acids may replace a serine of a light chain of the anti-CD19 antibody or fragment thereof. The one or more unnatural amino acids may replace a serine of a heavy chain of the anti-CD19 antibody or fragment thereof. The one or more unnatural amino acids may replace an alanine of a heavy chain of the anti-CD19 antibody or fragment thereof. The one or more unnatural amino acids may replace a lysine of a heavy chain of the anti-CD19 antibody or fragment thereof. The antibody or antibody fragment may be an anti-CD19 antibody or fragment thereof, wherein the one or more unnatural amino acids may replace one or more amino acids of a light chain of the anti-CD19 antibody or fragment thereof. The light chain of the anti-CD19 antibody or CD19-binding portion thereof may comprise one of SEQ ID NOS: 17-25; 27-35. The one or more unnatural amino acids may replace one or more amino acids of one of SEQ ID NOS: 17-25; 27-35. In some embodiments, the one or more amino acids of one of SEQ ID NOS: 17-25; 27-35 may be selected from G68 and K107. The one or more unnatural amino acids may replace one or more amino acids of a heavy chain of the anti-CD19 antibody or fragment thereof. The heavy chain of the anti-CD19 antibody or fragment thereof may comprise one of SEQ ID NOS: 2-15. The one or more unnatural amino acids may replace one or more amino acids of one of SEQ ID NOS: 2-15. The one or more amino acids of one of SEQ ID NOS: 2-15 may be S74.

Disclosed herein are methods of producing a switch of Formula I: X-L1-Y or Formula IA: Y-L1-X, wherein X is a CAR-ID, Y is a targeting moiety and L1 is a linker. X may be a CAR-binding small molecule and Y may be an antibody or antibody fragment. X may be a CAR-binding small molecule that does not comprise a peptide and Y may be a peptide that does not comprise an antibody or antibody fragment. X may be a CAR-binding small molecule that does not comprise a peptide and Y may be a targeting small molecule that does not comprise a peptide. The method may comprise conducting one or more reactions to attach the CAR-ID to a predetermined site in the targeting moiety. Conducting the one or more reactions to attach the CAR-ID to the targeting moiety may comprise mixing a plurality of CAR-IDs with a plurality of targeting moieties. The method may comprise attaching one end of the linker to the targeting moiety, followed by attachment of the other end of the linker to the CAR-ID. The method may comprise attaching one end of the linker to the CAR-ID, followed by attachment of the other end of the linker to the targeting moiety. Attachment of the linker to the targeting moiety may occur in a site-specific manner. The linker may be attached to a predetermined amino acid of the targeting moiety. The amino acid may be an unnatural amino acid. The linker may comprise a functional group that interacts with the amino acid. Attachment of the linker to the targeting moiety may occur in a site-independent manner. The linker may be randomly attached to the targeting moiety. The linker may comprise a functional group that reacts with a functional group in the targeting moiety. Attachment of the linker to the CAR-ID may occur in a site-specific manner. Attachment of the linker to the CAR-ID may occur in a site-independent manner. The linker may comprise a functional group that reacts with a functional group in the CAR-ID. Conducting the one or more reactions to attach the CAR-ID to the targeting moiety may comprise conducting an oxime ligation.

Alternatively, or additionally, the method may comprise conducting a reaction to attach the linker or a precursor of the linker to the CAR-ID to produce a switch intermediate comprising the linker conjugated to the CAR-ID. The switch intermediate may have the Formula II: X-L1 or Formula IIA: L1-X, wherein X is the CAR-ID and L1 is the linker or precursor of the linker. The linker may be conjugated to the CAR-ID in a site-specific manner. The linker may be conjugated to the CAR-ID in a site-independent manner. Conducting the one or more reactions to attach the CAR-ID to the targeting moiety may comprise attaching the linker portion of the switch intermediate to the targeting moiety. Conducting the one or more reactions to attach the CAR-ID to the targeting moiety may comprise contacting a plurality of switch intermediates comprising the linker or linker precursor conjugated to the CAR-ID with a plurality of targeting moieties. Attachment of the linker portion of the switch intermediate to the targeting moiety may occur in a site-specific manner. The targeting moiety may comprise one or more unnatural amino acids. The linker portion of the switch may be attached to the targeting moiety via the one or more unnatural amino acids. Attachment of the linker portion of the switch intermediate may occur in a site-independent manner.

Alternatively, or additionally, the method may comprise conducting a reaction to attach the linker or a precursor of the linker to the targeting moiety to produce a switch intermediate comprising the linker or precursor of the linker conjugated to the targeting moiety. The switch intermediate may be of Formula III: Y-L1 or Formula IIIA: L1-Y, wherein Y is the targeting moiety and L1 is the linker or linker precursor. The linker may be conjugated to the targeting moiety in a site-specific manner. The linker may be conjugated to the targeting moiety in a site-independent manner. Conducting the one or more reactions to attach the CAR-ID to the targeting moiety may comprise attaching the linker portion of the switch intermediate to the CAR-ID. Conducting the one or more reactions to attach the CAR-ID to the targeting moiety may comprise contacting a plurality of switch intermediates comprising the linker or linker precursor conjugated to the targeting moiety with a plurality of CAR-IDs. Attachment of the linker portion of the switch intermediate to the CAR-ID may occur in a site-specific manner. Attachment of the linker portion of the switch intermediate may occur in a site-independent manner.

The method may comprise coupling one or more linkers to the targeting moiety to produce a switch intermediate of Formula III: Y-L1 or Formula IIIA: L1-Y, wherein Y is the targeting moiety and L1 is the linker; and conjugating the switch intermediate to the CAR-ID, thereby producing the CAR-EC switch. The switch intermediate may be conjugated to the CAR-ID in a site-specific manner. The switch intermediate may be conjugated to the CAR-ID in a site-independent manner. The method may further comprise incorporating one or more unnatural amino acids into the CAR-ID and/or targeting moiety. The switch intermediate may be conjugated to the CAR-ID in a site-specific manner through the use of the unnatural amino acid.

The method may comprise coupling one or more linkers to the CAR-ID to produce a switch intermediate of Formula II: X-L1 or Formula IIA: L1-X, wherein X is the CAR-ID and L1 is the linker; and conjugating the switch intermediate to the targeting moiety, thereby producing the CAR-EC switch. The switch intermediate may be conjugated to the targeting moiety in a site-specific manner. The switch intermediate may be conjugated to the targeting moiety in a site-independent manner. The method may further comprise incorporating one or more unnatural amino acids into the CAR-ID and/or targeting moiety. The switch intermediate may be conjugated to the targeting moiety in a site-specific manner through the use of the unnatural amino acid.

Conjugating the switch intermediate of Formula II: X-L1 or Formula IIA: L1-X, wherein X is the CAR-ID and L1, to the targeting moiety may comprise forming an oxime. Conjugating the switch intermediate of Formula III: Y-L1 or Formula IIIA: L1-Y, wherein Y is the targeting moiety and L1, to the CAR-ID may comprise forming an oxime. Forming an oxime may comprise conducting one or more reactions under acidic conditions. Forming an oxime may comprise conducting one or more reactions under slightly acidic conditions. Forming an oxime may comprise conducting one or more reactions under slightly neutral conditions.

A method of producing a switch may comprise (a) producing a targeting moiety comprising an unnatural amino acid; (b) attaching a first linker to the targeting moiety to produce a first switch intermediate comprising the targeting moiety and the first linker; (c) attaching a second switch intermediate comprising a CAR-ID and a second linker to the first switch intermediate, thereby producing the switch. The unnatural amino acid may be p-acetylphenalanine (pAcF). The unnatural amino acid may be p-azidophenylalanine (pAzF) The targeting moiety may comprise a polypeptide based on or derived from an antibody or antibody fragment. The antibody may be an anti-CD19 antibody. The targeting moiety may comprise an antibody fragment. The antibody may comprise an amino acid sequence of any one of SEQ ID NOs: 2-15, 17-25 and 27-35. The first linker may be a bifunctional linker. The linker may be a heterobifunctional linker. The linker may comprise one or more polyethylene glycol (PEG) subunits. The first linker may comprise cyclooctyne. The first linker may be a PEG-cyclooctyne linker. The linker may comprise an azide. The first linker may comprise triazole. The triazole may be 1,2,3-triazole. The triazole may be 1,2,4-triazole. The first linker may comprise an azide-PEG-aminoxy linker. The first linker may be attached to a ketone of the unnatural amino acid. The first linker may be attached to the targeting moiety via oxime ligation. The CAR-ID may comprise a small molecule. The CAR-ID may comprise FITC. The second linker may be a bifunctional linker. The linker may be a heterobifunctional linker. The linker may comprise one or more polyethylene glycol (PEG) subunits. The second linker may comprise cyclooctyne. The second linker may be a PEG-cyclooctyne linker. The linker may comprise an azide. The second linker may comprise triazole. The triazole may be 1,2,3-triazole. The triazole may be 1,2,4-triazole. The second linker may be a PEG-cyclooctyne linker. The second switch intermediate may be attached to the first switch intermediate via a click chemistry reaction. The second switch intermediate may be attached to the first switch intermediate through a cycloaddition reaction. The cycloaddition reaction may be a [3+2] cycloaddition reaction.

Conjugating the linker to the CAR-ID to produce the switch may comprise forming one or more bonds between the linker and the CAR-ID. Conjugating the linker to the targeting moiety to produce the switch may comprise forming one or more bonds between the linker and the targeting moiety. The one or more bonds may comprise an ionic bond, a covalent bond, a non-covalent bond or a combination thereof. Additional methods of conjugating the linker the CAR-ID and the targeting moiety may be performed as described in Roberts et al., Advanced Drug Delivery Reviews 54:459-476 (2002), which is included by reference in its entirety.

The CAR-ID may comprise any of the CAR-IDs disclosed herein. For example, the CAR-ID may comprise a small molecule. The CAR-ID may comprise FITC. The CAR-ID may be selected from the group consisting of DOTA, dinitrophenol, quinone, biotin, aniline, atrazine, an aniline-derivative, o-aminobenzoic acid, p-aminobenzoic acid, m-aminobenzoic acid, hydralazine, halothane, digoxigenin, benzene arsonate, lactose, trinitrophenol, biotin and derivatives thereof.

The CAR-ID may comprise a hapten. The CAR-ID may induce an immune response when attached to a larger carrier molecule, such as a protein, antibody or antibody fragment. The CAR-ID may be FITC or a derivative thereof. The CAR-ID may comprise biotin. The CAR-ID may comprise dinitrophenol.

Alternatively, the CAR-ID does not comprise a hapten. The CAR-ID may be selected from a steroid, a vitamin, a vitamer, a metabolite, an antibiotic, a monosaccharide, a disaccharide, a lipid, a fatty acid, a nucleic acid, an alkaloid, a glycoside, a phenzine, a polyketide, a terpene, and a tetrapyrrole, and portions thereof, and combinations thereof. The CAR-ID may be a penicillin drug or a derivative thereof.

The CAR-ID may be linked and/or conjugated to the target interacting domain. The target interacting domain may be a targeting antibody or antibody fragment and the CAR-ID may be linked and/or conjugated to an amino acid of the targeting antibody or antibody fragment. The amino acid of the targeting antibody or antibody fragment may be an unnatural amino acid. The targeting antibody or antibody fragment may comprise a light chain and/or heavy chain selected from SEQ ID NOS: 10-31 and the unnatural amino acids may be located at respective sites shown in Table 1. Unless otherwise noted, amino acids are counted from the amino acid of the N-terminus of each variable region to the C-terminus of the constant region.

The targeting moiety may comprise any of the targeting moieties disclosed herein. The linker may comprise any of the linkers disclosed herein. For example, the linker may comprise an aminooxy group, azide group cyclooctyne group, or a combination thereof at one or more termini. The linker may be a bifunctional linker. The linker may be a heterobifunctional linker. The linker may comprise one or more PEG subunits.

Disclosed herein are methods of producing a switch of Formula IV: X-L1-L2-Y, wherein in X is a CAR-ID, L1 is a first linker, L2 is a second linker and Y is a targeting moiety. The method may comprise (a) coupling L1 to X to produce a first switch intermediate of Formula II: X-L1; (b) coupling L2 to Y to produce a second switch intermediate of Formula V: L2-Y; and (c) linking the first switch intermediate of Formula II to the second switch intermediate of Formula: V, thereby producing the switch of Formula IV.

Disclosed herein are methods of producing a switch of Formula IVA: Y-L2-L1-X, wherein Y is a targeting moiety, L1 is a first linker, L2 is a second linker and X is a CAR-ID. The method may comprise (a) coupling L1 to X to produce a first switch intermediate of Formula IIA: L1-X; (b) coupling L2 to Y to produce a second switch intermediate of Formula VA: Y-L2; and (c) linking the first intermediate of Formula IIA to the second intermediate of Formula VA, thereby producing the CAR-EC switch of Formula IVA.

The methods may further comprise incorporating one or more unnatural amino acids into X and/or Y. The L1 may be coupled to X in a site-specific manner. The L1 may be coupled to X in a site-specific manner through the one or more unnatural amino acids. L2 may be coupled to Y in a site-specific manner. The L2 may be coupled to Y in a site-specific manner through the one or more unnatural amino acids. The method may further comprise modifying a nucleic acid encoding X to produce one or more amber codons in X. The method may further comprise modifying a nucleic acid encoding Y to produce one or more amber codons in Y.

Conjugating the linker to the CAR-ID to produce the first switch intermediate may comprise forming one or more bonds between the linker and the CAR-ID. Conjugating the linker to the targeting moiety to produce the second switch intermediate may comprise forming one or more bonds between the linker and the targeting moiety. The one or more bonds may comprise an ionic bond, a covalent bond, a non-covalent bond or a combination thereof. Additional methods of conjugating the linker the CAR-ID and the targeting moiety may be performed as described in Roberts et al., Advanced Drug Delivery Reviews 54:459-476 (2002), which is included by reference in its entirety.

Linking the first switch intermediate to the second switch intermediate may comprise a Huisgen-cycloaddition, a Diels-Halder reaction, a hetero Diels-Alder reaction or an enzyme-mediated reaction. Linking the first switch intermediate to the second switch intermediate may produce an oxime, a tetrazole, a Diels Alder adduct, a hetero Diels Alder adduct, an aromatic substitution reaction product, a nucleophilic substitution reaction product, an ester, an amide, a carbamate, an ether, a thioether, a Michael reaction product, cycloaddition product, a metathesis reaction product, a metal-mediated cross-coupling reaction product, a radical polymerization product, an oxidative coupling product, an acyl-transfer reaction product, or a photo click reaction product. Linking the first switch intermediate to the second switch intermediate may produce a disulfide bridge or a maleimide bridge.

L1 and/or L2 may comprise a linker selected from a bifunctional linker, a cleavable linker, a non-cleavable linker, an ethylene glycol linker, a bifunctional ethylene glycol linker, a flexible linker, or an inflexible linker. L1 and/or L2 may comprise a linker selected from the group comprising cyclooctyne, cyclopropene, aryl/alkyl azides, trans-cyclooctene, norborene, and tetrazines. A terminus of L1 and/or a terminus of L2 may comprise an alkoxy-amine. A terminus of L1 and/or a terminus of L2 may comprise an azide or cyclooctyne group. X may be coupled to L1 by a chemical group selected from a cyclooctyne, cyclopropene, aryl/alkyl azide, trans-cyclooctene, norborene, and tetrazine. Linking the first switch intermediate (X-L1 or L1-X) and second switch intermediate (Y-L2 or L2-Y) may comprise conducting one or more copper-free reactions. Linking the first switch intermediate (X-L1 or L1-X) and second switch intermediate (Y-L2 or L2-Y) may comprise conducting one or more copper-containing reactions. Linking the first switch intermediate (X-L1 or L1-X) and second switch intermediate (Y-L2 or L2-Y) may comprise one or more cycloadditions. Linking the first switch intermediate (X-L1 or L1-X) and second switch intermediate (Y-L2 or L2-Y) may comprise one or more Huisgen-cycloadditions. Linking the first switch intermediate (X-L1 or L1-X) and second switch intermediate (Y-L2 or L2-Y) may comprise one or more Diels Alder reactions. Linking the first switch intermediate (X-L1 or L1-X) and second switch intermediate (Y-L2 or L2-Y) may comprise one or more Hetero Diels Alder reaction.

The methods disclosed herein may comprise coupling one or more linkers to one or more target interacting domain, CAR-IDs or combinations thereof to produce one or more switch intermediates. The switch intermediate may comprise a targeting moiety attached to a linker (e.g., targeting moiety switch intermediate). The switch intermediate may comprise a CAR-ID attached to a linker (e.g., CAR-ID switch intermediates). The methods may comprise coupling a first linker to targeting moiety to produce a targeting moiety switch intermediate. The methods may comprise coupling a linker to a CAR-ID to produce a CAR-ID switch intermediate.

Coupling of the one or more linkers to the targeting moiety and the CAR-ID may occur simultaneously. Coupling of the one or more linkers to the targeting moiety and the CAR-ID may occur sequentially. Coupling of the one or more linkers to the targeting moiety and the CAR-ID may occur in a single reaction volume. Coupling of the one or more linkers to the targeting moiety and the CAR-ID may occur in two or more reaction volumes.

Coupling one or more linkers to the targeting moiety and/or the CAR-ID may comprise forming one or more oximes between the linker and the targeting moiety and/or the CAR-ID. Coupling one or more linkers to the targeting moiety and/or the CAR-ID may comprise forming one or more stable bonds between the linker and the targeting moiety and/or the CAR-ID. Coupling one or more linkers to the targeting moiety and/or the CAR-ID may comprise forming one or more covalent bonds between the linker and the targeting moiety and/or the CAR-ID. Coupling one or more linkers to the targeting moiety and/or the CAR-ID may comprise forming one or more non-covalent bonds between the linker and targeting moiety and/or the CAR-ID. Coupling one or more linkers to the targeting moiety and/or the CAR-ID may comprise forming one or more ionic bonds between the linker and the targeting moiety and/or the CAR-ID.

Coupling one or more linkers to the targeting moiety and/or the CAR-ID may comprise site-specifically coupling one or more linkers to the targeting moiety and/or the CAR-ID. Site-specific coupling may comprise linking the one or more linkers to the unnatural amino acid of the targeting moiety and/or the CAR-ID. Linking the one or more linkers to the unnatural amino acid of the targeting moiety and/or the CAR-ID may comprise formation of an oxime. Linking the one or more linkers to the unnatural amino acid of the targeting moiety and/or the CAR-ID may comprise, by way of non-limiting example, reacting a hydroxylamine of the one or more linkers with an aldehyde or ketone of an amino acid. The amino acid may be an unnatural amino acid.

Conducting the one or more reactions to site-specifically link the CAR-ID to the targeting moiety, to site-specifically attach the linker or a precursor of the linker to the CAR-ID, to site-specifically attach the linker or a precursor of the linker to the targeting moiety, to site-specifically attach the CAR-ID switch intermediate to the targeting moiety, to site-specifically attach the targeting moiety switch intermediate to the CAR-ID or to site-specifically attach the targeting moiety switch intermediate to the CAR-ID switch intermediate may comprise conducting one or more reactions selected from a copper-free reaction, a cycloadditions, a Huisgen-cycloaddition, a copper-free [3+2] Huisgen-cycloaddition, a copper-containing reaction, a Diels Alder reactions, a hetero Diels Alder reaction, metathesis reaction, a metal-mediated cross-coupling reaction, a radical polymerization, an oxidative coupling, an acyl-transfer reaction, a photo click reaction, an enzyme-mediated reaction, a transglutaminase-mediated reaction.

The switches disclosed herein may comprise a CAR-ID comprising FITC or a derivative thereof. The method of producing such switches may comprise coupling a linker or precursor thereof, a switch intermediate comprising a targeting moiety (e.g., targeting moiety switch intermediate), or a targeting moiety to the CAR-ID. Coupling the linker or precursor thereof, the targeting moiety switch intermediate to the CAR-ID may comprise conjugation of an isothiocyanate of FITC to the linker or precursor thereof, targeting moiety switch intermediate or targeting moiety. The targeting moiety may be based on or derived from a polypeptide. The polypeptide may be an antibody or antibody fragment. Coupling a targeting moiety to the CAR-ID may comprise conjugating the isothiocyanate of FITC to an amino acid of the targeting moiety. The amino acid may be a lysine. The method may comprise coupling or more CAR-IDs to the targeting moiety. The method may comprise conjugating FITC from two or more CAR-IDs to two or more amino acids of the targeting moiety. The two or more amino acids may be lysine.

Producing a switch disclosed herein may comprise ester coupling. Ester coupling may comprise forming an amide bond between the CAR-ID and the targeting moiety. Ester coupling may comprise forming an amide bond between a switch intermediate and the targeting moiety. The switch intermediate may comprise a CAR-ID attached to a linker. The amide bond may be formed between the linker of the switch intermediate and the targeting moiety. The linker may be a NHS-ester linker. The amide bond may be formed between the linker of the switch intermediate and an amino acid of the targeting moiety. The CAR-ID may comprise a small molecule. The small molecule may be FITC. The targeting moiety may be based on or derived from a polypeptide. The polypeptide may be an antibody or antibody fragment. The targeting moiety may comprise a small molecule.

The method of producing a switch disclosed herein may comprise: (a) obtaining a switch intermediate comprising (i) a CAR-ID; and (ii) a linker; and (b) contacting the switch intermediate with a targeting moiety, thereby producing the switch. Contacting the switch intermediate with the targeting moiety may comprise performing an ester coupling reaction. The linker may comprise a NHS-ester linker. The targeting moiety may comprise one or more amino acids. Performing the ester coupling reaction may comprise forming an amide bond between the NHS-ester linker of the switch intermediate and the one or more amino acids of the targeting moiety. The method may further comprise producing a plurality of switches. Two or more switches of the plurality of switches may comprise two or more switch intermediates attached to two or more different amino acids of the targeting moiety. For example, a first switch intermediate may be attached to a lysine residue of a first targeting moiety and a second switch intermediate may be attached to a glycine residue of a second targeting moiety. Two or more switches of the plurality of switches may comprise two or more switch intermediates attached to the same amino acid of the targeting moiety. For example, the two or more switch intermediates may be attached to a lysine residue of a first and second targeting moiety. Two or more switches of the plurality of switches may comprise two or more switch intermediates attached to the same amino acid located at two or more different positions in the targeting moiety. For example, a first switch intermediate may be attached to lysine 10 of a first targeting moiety and the second switch intermediate may be attached to lysine 45 of a second targeting moiety. Two or more switches of the plurality of switches may comprise two or more switch intermediates attached to the same amino acid located at the same position in the targeting moiety. For example, a first switch intermediate may be attached to lysine 10 of a first targeting moiety and the second switch intermediate may be attached to lysine 10 of a second targeting moiety.

Methods of producing a switch disclosed herein may comprise using one or more unnatural amino acids. The method may comprise incorporating one or more unnatural amino acids into the CAR-ID. The CAR-ID may be based on or derived from a polypeptide that can interact with a CAR on an effector cell. The polypeptide may be a non-antibody based polypeptide. Generally, a non-antibody based polypeptide is a polypeptide that does not comprise an antibody or antibody fragment. The unnatural amino acid may be incorporated into the non-antibody based polypeptide. The unnatural amino acid may replace an amino acid of the non-antibody based polypeptide. Alternatively, or additionally, the method may comprise incorporating one or more unnatural amino acids into the targeting moiety. The targeting moiety may be based on or derived from a polypeptide. The polypeptide may be an antibody. The polypeptide may be a non-antibody based polypeptide. The unnatural amino acid may be incorporated into the polypeptide. The unnatural amino acid may replace an amino acid of the polypeptide.

The method of producing the switch may further comprise modifying one or more amino acid residues in polypeptide from which the CAR-ID is based or derived. The method of producing the switch may comprise modifying one or more amino acid residues in polypeptide from which the targeting moiety is based or derived. Modifying the one or more amino acid residues may comprise mutating one or more nucleotides in the nucleotide sequence encoding the polypeptide. Mutating the one or more nucleotides in the nucleotide sequence encoding may comprise altering a codon encoding an amino acid to a nonsense codon.

Incorporating one or more unnatural amino acids into the polypeptide from which the CAR-ID is based or derived may comprise modifying one or more amino acid residues in the polypeptide to produce one or more amber codons in the antibody or antibody fragment. Incorporating one or more unnatural amino acids into the polypeptide from which the targeting moiety is based or derived may comprise modifying one or more amino acid residues in the polypeptide to produce one or more amber codons in the antibody or antibody fragment.

The one or more unnatural amino acids may be incorporated into the polypeptide in response to an amber codon. The one or more unnatural amino acids may be site-specifically incorporated into the polypeptide.

Incorporating one or more unnatural amino acids into the polypeptide from which the CAR-ID and the targeting moiety are based or derived may comprise use of one or more genetically encoded unnatural amino acids with orthogonal chemical reactivity relative to the canonical twenty amino acids to site-specifically modify the antibody, antibody fragment, or targeting peptide. Incorporating one or more unnatural amino acids may comprise the use of one or more tRNA synthetases. The tRNA synthetase may be an aminoacyl tRNA synthetase. The tRNA synthetase may be a mutant tRNA synthesis. Incorporating one or more unnatural amino acids may comprise a tRNA/tRNA synthetase pair. The tRNA/tRNA synthetase pair may comprise a tRNA/aminoacyl-tRNA synthetase pair. The tRNA/tRNA synthetase pair may comprise a tRNATyr/tyrosyl-tRNA synthetase pair. Incorporating the one or more unnatural amino acids may comprise use of an evolved tRNA/aminoacyl-tRNA synthetase pair to site-specifically incorporate one or more unnatural amino acids at defined sites in the polypeptide in response to one or more amber nonsense codon.

Additional methods for incorporating unnatural amino acids include, but are not limited to, methods disclosed in Chatterjee et al. (A Versatile Platform for Single- and Multiple-Unnatural Amino Acid Mutagenesis in *Escherichia coli*, Biochemistry, 2013), Kazane et al. (*J Am Chem Soc*, 135(1):340-6, 2013), Kim et al. (*J Am Chem Soc*, 134(24): 9918-21, 2012), Johnson et al. (*Nat Chem Biol*, 7(11):779-86, 2011) and Hutchins et al. (*J Mol Biol*, 406(4):595-603, 2011).

A method of producing a switch for activating a chimeric antigen receptor-effector cell (CAR-EC) may comprise (a) obtaining a targeting moiety comprising an unnatural amino acid; and (b) attaching a chimeric antigen receptor-interacting domain (CAR-ID) to the targeting moiety, thereby producing the switch. Thus, in some embodiments the method comprises attaching a CAR-ID to an unnatural amino acid comprised in a targeting moiety that is a humanized anti-CD19 antibody or a CD19-binding fragment thereof.

Attaching the CAR-ID to the targeting moiety may comprise one or cycloadditions. The one or more cycloadditions may comprise a Huisgen cycloaddition. The one or more cycloadditions may comprise a [3+2] cycloaddition. The one or more cycloadditions may comprise a [3+2] Huisgen cycloaddition. The one or more cycloadditions may comprise a copper-free cycloaddition. Attaching the CAR-ID to the targeting moiety may comprise a copper free reaction. Attaching the CAR-ID to the targeting moiety may comprise one or more copper-containing reactions. Attaching the CAR-ID to the targeting moiety may comprise one or more Diels Alder reactions. Attaching the CAR-ID to the targeting moiety may comprise one or more hetero Diels Alder reactions. Attaching the CAR-ID to the targeting moiety may comprise one or more ester couplings. Attaching the CAR-ID to the targeting moiety may comprise one or more isothiocyanate couplings. Attaching the CAR-ID to the targeting moiety may comprise attaching the CAR-ID to an amino acid of targeting moiety. The amino acid may be an unnatural amino acid. Attaching the CAR-ID to the targeting moiety may comprise one or more bioorthogonal reactions. The CAR-ID may be attached to the targeting moiety in a site-specific manner. The CAR-ID may be attached to a predetermined site in the targeting moiety. The CAR-ID may be attached to the targeting moiety in a site-independent manner.

The method may further comprise attaching a first linker to the targeting moiety to produce first switch intermediate. Attaching the first linker to the targeting moiety may comprise one or cycloadditions. Attaching the first linker to the targeting moiety may comprise a copper free reaction. Attaching the first linker to the targeting moiety may comprise one or more copper-containing reactions. Attaching the first linker to the targeting moiety may comprise one or more Diels Alder reactions. Attaching the first linker to the targeting moiety may comprise one or more hetero Diels Alder reactions. Attaching the first linker to the targeting moiety may comprise one or more ester couplings. Attaching the first linker to the targeting moiety may comprise oxime ligation. Attaching the first linker to the targeting moiety may comprise forming one or more oximes between the first linker and the targeting moiety. Attaching the first linker to the targeting moiety may comprise forming one or more stable bonds between the first linker and the targeting moiety. Attaching the first linker to the targeting moiety may comprise forming one or more covalent bonds between the first linker and the targeting moiety. Attaching the first linker to the targeting moiety may comprise forming one or more non-covalent bonds between the first linker and the targeting moiety. Attaching the first linker to the targeting moiety may comprise forming one or more ionic bonds between the first linker and the targeting moiety. Attaching the first linker to the targeting moiety may comprise attaching the linker to an amino acid of targeting moiety. The amino acid may be an unnatural amino acid. Attaching the first linker to the targeting moiety may comprise one or more bioorthogonal reactions.

Attaching the CAR-ID to the targeting moiety may comprise attaching the first switch intermediate to the CAR-ID. Attaching the first switch intermediate to the CAR-ID may comprise one or cycloadditions. The one or more cycloadditions may comprise a Huisgen cycloaddition. The one or more cycloadditions may comprise a [3+2] cycloaddition. The one or more cycloadditions may comprise a [3+2] Huisgen cycloaddition. The one or more cycloadditions may comprise a copper-free cycloaddition. Attaching the first switch intermediate to the CAR-ID may comprise a copper free reaction. Attaching the first switch intermediate to the CAR-ID may comprise one or more copper-containing reactions. Attaching the first switch intermediate to the CAR-ID may comprise one or more Diels Alder reactions. Attaching the first switch intermediate to the CAR-ID may comprise one or more hetero Diels Alder reactions. Attaching the first switch intermediate to the CAR-ID may comprise one or more ester couplings. Attaching the first switch intermediate to the CAR-ID may comprise one or more isothiocyanate couplings.

The method may further comprise attaching a second linker to the CAR-ID to produce a second switch intermediate. Attaching the second linker to the CAR-ID may comprise one or cycloadditions. Attaching the second linker to the CAR-ID may comprise a copper free reaction. Attaching the second linker to the CAR-ID may comprise one or more copper-containing reactions. Attaching the second linker to the CAR-ID may comprise one or more Diels Alder reactions. Attaching the second linker to the CAR-ID may comprise one or more hetero Diels Alder reactions. Attaching the second linker to the CAR-ID may comprise one or more ester couplings. Attaching the second linker to the CAR-ID may comprise oxime ligation. Attaching the second linker to the CAR-ID may comprise forming one or more oximes between the second linker and the CAR-ID. Attaching the second linker to the CAR-ID may comprise forming one or more stable bonds between the second linker and the CAR-ID. Attaching the second linker to the CAR-ID may comprise forming one or more covalent bonds between the second linker and the CAR-ID. Attaching the second linker to the CAR-ID may comprise forming one or more non-covalent bonds between the second linker and the CAR-ID. Attaching the second linker to the CAR-ID may comprise forming one or more ionic bonds between the second linker and the CAR-ID.

Attaching the CAR-ID to the targeting moiety may comprise attaching the second switch intermediate to the targeting moiety. Attaching the second switch intermediate to the targeting moiety may comprise one or cycloadditions. The one or more cycloadditions may comprise a Huisgen cycloaddition. The one or more cycloadditions may comprise a [3+2] cycloaddition. The one or more cycloadditions may comprise a [3+2] Huisgen cycloaddition. The one or more cycloadditions may comprise a copper-free cycloaddition. Attaching the second switch intermediate to the targeting moiety may comprise a copper free reaction. Attaching the second switch intermediate to the targeting moiety may comprise one or more copper-containing reactions. Attaching the second switch intermediate to the targeting moiety may comprise one or more Diels Alder reactions. Attaching the second switch intermediate to the targeting moiety may comprise one or more hetero Diels Alder reactions. Attaching the second switch intermediate to the targeting moiety may comprise one or more ester couplings. Attaching the second switch intermediate to the targeting moiety may comprise one or more isothiocyanate couplings. Attaching the second switch intermediate to the targeting moiety may comprise attaching the linker to an amino acid of CAR-ID. The amino acid may be an unnatural amino acid. Attaching the second switch intermediate to the targeting moiety may comprise one or more bioorthogonal reactions.

Attaching the CAR-ID to the targeting moiety may comprise attaching the first switch intermediate to the second switch intermediate. Attaching the first switch intermediate to the second switch intermediate may comprise one or cycloadditions. The one or more cycloadditions may comprise a Huisgen cycloaddition. The one or more cycloadditions may comprise a [3+2] cycloaddition. The one or more cycloadditions may comprise a [3+2] Huisgen cycloaddition. The one or more cycloadditions may comprise a copper-free cycloaddition. Attaching the first switch intermediate to the second switch intermediate may comprise a copper free reaction. Attaching the first switch intermediate to the second switch intermediate may comprise one or more copper-containing reactions. Attaching the first switch intermediate to the second switch intermediate may comprise one or more Diels Alder reactions. Attaching the first switch intermediate to the second switch intermediate may comprise one or more hetero Diels Alder reactions. Attaching the first switch intermediate to the second switch intermediate may comprise one or more ester couplings. Attaching the first switch intermediate to the second switch intermediate may comprise one or more isothiocyanate couplings.

Disclosed herein are CAR-EC switches comprising (a) a CAR-ID comprising a peptide from a yeast transcription factor peptide; and (b) a humanized FMC63 antibody or an antigen binding portion thereof (e.g., any one of the humanized FMC63 antibodies described herein). The yeast transcription factor peptide may be a GCN4 peptide. The humanized FMC63 antibody or antibody fragment may comprise a heavy chain of a humanized FMC63 antibody. The heavy chain sequence may comprise any one of SEQ ID NOS: 2-15. The humanized FMC63 antibody or antibody fragment may comprise a light chain a humanized FMC63 antibody. The light chain sequence may comprise any one of SEQ ID NOS: 17-25 or any one of SEQ ID NOS: 27-35. The humanized FMC63 antibody or antibody fragment may comprise a Fab of a humanized FMC63 antibody. The humanized FMC63 antibody or antibody fragment may comprise a full length humanized FMC63 antibody or a fragment thereof. Disclosed herein is also an anti-GCN4 CAR and a CAR-EC expressing an anti-GCN4 CAR. In some embodiments, co-treatment of a subject with (i) a CAR-EC switch comprising (a) a CAR-ID comprising a peptide from a yeast transcription factor peptide (e.g., a GCN4 peptide disclosed herein); and (b) a humanized FMC63 antibody or an antigen binding portion thereof (e.g., any one of the humanized FMC63 antibodies described herein) and (ii) a CAR-EC expressing an anti-GCN4 CAR results in switch mediated cytotoxicity of a CD19-expressing target cell.

Disclosed herein are CAR-EC switches comprising (a) a CAR-ID comprising a Flag peptide; and (b) a humanized FMC63 antibody or an antigen binding portion thereof (e.g., any one of the humanized FMC63 antibodies described herein). The Flag peptide may comprise any one of the following sequences: DYKDDDDK (SEQ ID NO: 40) and DYKDDDDKP (SEQ ID NO: 39). The humanized FMC63 antibody or antibody fragment may comprise a heavy chain of a humanized FMC63 antibody. The heavy chain sequence may comprise any one of SEQ ID NOS: 2-15. The humanized FMC63 antibody or antibody fragment may comprise a light chain a humanized FMC63 antibody. The light chain sequence may comprise any one of SEQ ID NOS: 17-25 or any one of SEQ ID NOS: 27-35. The humanized FMC63 antibody or antibody fragment may comprise a Fab of a humanized FMC63 antibody. The humanized FMC63 antibody or antibody fragment may comprise a full length humanized FMC63 antibody or a fragment thereof. Disclosed herein is also an anti-Flag CAR and a CAR-EC expressing an anti-Flag CAR. In some embodiments, co-treatment of a subject with (i) a CAR-EC switches comprising (a) a CAR-ID comprising a Flag peptide; and (b) a humanized FMC63 antibody or an antigen binding portion thereof (e.g., any one of the humanized FMC63 antibodies described herein) and (ii) a CAR-EC expressing an anti-Flag CAR results in switch mediated cytotoxicity of a CD19-expressing target cell.

Disclosed herein are CAR-EC switches comprising (a) a CAR-ID comprising FITC; and (b) a humanized FMC63 antibody or an antigen binding portion thereof (e.g., any one of the humanized FMC63 antibodies described herein). The FITC may be conjugated to the humanized FMC63 antibody non-specifically. The FITC may be conjugated to the humanized FMC63 antibody site-specifically. The site-specific conjugation may be to an artificial amino acid comprised in the humanized FMC63 antibody. The conjugation may be via a linker that links the humanized FMC63 antibody to the FITC. The humanized FMC63 antibody or antibody fragment may comprise a heavy chain of a humanized FMC63 antibody. The heavy chain sequence may comprise any one of SEQ ID NOS: 2-15. The humanized FMC63 antibody or antibody fragment may comprise a light chain a humanized FMC63 antibody. The light chain sequence may comprise any one of SEQ ID NOS: 17-25 or any one of SEQ ID NOS: 27-35. The humanized FMC63 antibody or antibody fragment may comprise a Fab of a humanized FMC63 antibody. The humanized FMC63 antibody or antibody fragment may comprise a full length humanized FMC63 antibody or a fragment thereof. Disclosed herein is also an anti-FITC CAR and a CAR-EC expressing an anti-FITC CAR. In some embodiments, co-treatment of a subject with (i) a CAR-EC switches comprising (a) a CAR-ID comprising a FITC; and (b) a humanized FMC63 antibody or an antigen binding portion thereof (e.g., any one of the humanized FMC63 antibodies described herein) and (ii) a CAR-EC expressing an anti-FITC CAR results in switch mediated cytotoxicity of a CD19-expressing target cell.

Disclosed herein are CAR-EC switches comprising (a) a CAR-ID comprising a K4 peptide or an E4 peptide; and (b) a humanized FMC63 antibody or an antigen binding portion thereof (e.g., any one of the humanized FMC63 antibodies described herein). The K4 peptide may comprise the amino acid sequence: KVAALKEKVAALKEKVAALKEKVAALKE (SEQ ID NO: 43). The E4 peptide may comprise the amino acid sequence: EVAALEKEVAALEKEVAALEKEVAALEK (SEQ ID NO: 44). The humanized FMC63 antibody or antibody fragment may comprise a heavy chain of a humanized FMC63 antibody. The heavy chain sequence may comprise any one of SEQ ID NOS: 2-15. The humanized FMC63 antibody or antibody fragment may comprise a light chain a humanized FMC63 antibody. The light chain sequence may comprise any one of SEQ ID NOS: 17-25 or any one of SEQ ID NOS: 27-35. The humanized FMC63 antibody or antibody fragment may comprise a Fab of a humanized FMC63 antibody. The humanized FMC63 antibody or antibody fragment may comprise a full length humanized FMC63 antibody or a fragment thereof. Disclosed herein is also a CAR comprising a K4 extracellular domain. Disclosed herein is also a CAR comprising an E4 extracellular domain. Disclosed herein is also a CAR-EC expressing a CAR comprising a K4 extracellular domain. Disclosed herein is also a CAR-EC expressing a CAR comprising a E4 extracellular domain.

In some embodiments, co-treatment of a subject with (i) a CAR-EC switch comprising (a) a CAR-ID comprising a K4 peptide; and (b) a humanized FMC63 antibody or an antigen binding portion thereof (e.g., any one of the humanized FMC63 antibodies described herein) and (ii) a CAR-EC expressing a CAR comprising an E4 extracellular domain results in switch mediated cytotoxicity of a CD19-expressing target cell. In some embodiments, co-treatment of a subject with (i) a CAR-EC switch comprising (a) a CAR-ID comprising a E4 peptide; and (b) a humanized FMC63 antibody or an antigen binding portion thereof (e.g., any one of the humanized FMC63 antibodies described herein) and (ii) a CAR-EC expressing a CAR comprising an K4 extracellular domain results in switch mediated cytotoxicity of a CD19-expressing target cell.

III. Purification of CAR-EC Switches and Portions Thereof

Disclosed herein are methods of purifying humanized CAR-EC switches disclosed herein, comprising separating the humanized CAR-EC switches disclosed herein from components of a CAR-EC switch production system (e.g., cellular debris, free amino acids). Purifying the CAR-EC switch may comprise use of one or more concentrator columns, electrophoresis, filtration, centrifugation, chromatography or a combination thereof. Chromatography may comprise size-exclusion chromatography. Additional chromatography methods include, but are not limited to, hydrophobic interaction chromatography, ion exchange chromatography, affinity chromatography, metal binding, immunoaffinity chromatography, and high performance liquid chromatography or high pressure liquid chromatography. Electrophoresis may comprise denaturing electrophoresis or non-denaturing electrophoresis.

The humanized CAR-EC switches may comprise one or more peptide tags. The methods of purifying humanized CAR-EC switches may comprise binding one or more peptide tags of the humanized CAR-EC switches to a capturing agent. The capturing agent may be selected from an antibody, a column, a bead and a combination thereof. The one or more tags may be cleaved by one or more proteases. Examples of tags include, but are not limited to, polyhistidine, FLAG® tag, HA, c-myc, V5, chitin binding protein (CBP), maltose binding protein (MBP), and glutathione-S-transferase (GST). The peptide tag may be the CAR-ID. The peptide tag may be HTP. The peptide tag may be yeast transcription factor GCN4.

The methods may further comprise lyophilization or ultracentrifugation of the CAR-IDs, targeting polypeptides and/or the humanized CAR-EC switches.

The purity of the CAR-IDs, targeting polypeptides and/or the humanized CAR-EC switches may be equal to or greater than 50%, 55%, 60%, 65%, 70%, 75%, 80%, 85%, 90%, 91%, 92%, 93%, 94%, 95%, 96%, 97%, 98%, 99% or more. The purity of the CAR-IDs, targeting polypeptides and/or the humanized CAR-EC switches may be equal to or greater than 85%. The purity of the CAR-IDs, targeting polypeptides and/or the humanized CAR-EC switches may be equal to or greater than 90%. The purity of the CAR-IDs, targeting polypeptides and/or the humanized CAR-EC switches may be equal to or greater than 95%. The purity of the CAR-IDs, targeting polypeptides and/or the humanized CAR-EC switches may be equal to or greater than 97%. A humanized CAR-EC switch purified according to such methods of purifying humanized CAR-EC switches is referred to herein as a "purified CAR-EC switches" or a "purified humanized CAR-EC switch." The purified CAR-EC switches may be endotoxin-free or substantially endotoxin-free.

The methods of producing humanized CAR-EC switches disclosed herein may comprise producing humanized CAR-EC switches that are structurally homogeneous. The method of producing the CAR-EC switch from a polynucleotide may result in one or more humanized CAR-EC switches that have the same or similar form, features, binding affinities (e.g., for the CAR or the target), geometry and/or size. The homogeneity of the humanized CAR-EC switches may be equal to or greater than 50%, 55%, 60%, 65%, 70%, 75%, 80%, 85%, 90%, 91%, 92%, 93%, 94%, 95%, 96%, 97%, 98%, 99% or more. The homogeneity of the humanized CAR-EC switches may be equal to or greater than 85%. The homogeneity humanized CAR-EC switches may be equal to or greater than 90%. The homogeneity of the humanized CAR-EC switches may be equal to or greater than 95%. The homogeneity of the humanized CAR-EC switches may be equal to or greater than 97%. The homogeneity may be a structural homogeneity. The homogeneity may be a structural homogeneity prior to administering the cell to a subject. The homogeneity may be a structural homogeneity prior to modifications to the CAR-EC switch by cellular activities (methylation, acetylation, glycosylation, etc.). These high percentages of homogeneity may provide a more predictable effect of the CAR-EC switch. These high percentages of homogeneity may provide for less off-target effects of the CAR-EC switch, when combined with a CAR-EC to treat a condition in a subject.

IV. Pharmaceutical Compositions

Disclosed herein is a pharmaceutical composition comprising one or more of the humanized CAR-EC Switches disclosed herein. One or more of the CAR-EC switches may be a purified CAR-EC switch. In some embodiments, the pharmaceutical composition comprises one or more purified humanized CAR-EC Switch disclosed herein. The compositions may further comprise one or more pharmaceutically acceptable salts, excipients or vehicles. The pharmaceutical compositions may be endotoxin-free or substantially endotoxin-free.

In some embodiments, the disclosure provides a pharmaceutical composition comprising a pharmaceutically acceptable salt, an excipient, a vehicle, or a combination thereof, and a CAR-EC switch comprising a light chain and a heavy chain, wherein the light chain comprises or consists of any switch light chain sequence disclosed herein and the heavy chain comprises or consists of any switch heavy chain sequence disclosed herein. Such heavy and/or light chain sequences may be humanized. In some embodiments, the CAR-EC switch comprised in the pharmaceutical composition is humanized and comprises a light chain sequence selected from SEQ ID NOS: 17-24 and a heavy chain sequence selected from SEQ ID NOS: 2-14, wherein one or both of the heavy and light chains comprise a CAR-ID disclosed herein (e.g., a GCN4 CAR-ID). In some embodiments, the CAR-EC switch comprised in the pharmaceutical composition is humanized and comprises a light chain sequence that is at least 85%, 90%, 95%, 96%, 97%, 98%, or at least 99% identical to a sequence selected from SEQ ID NOS: 17-24 and a heavy chain sequence that is at least 85%, 90%, 95%, 96%, 97%, 98%, or at least 99% identical to a sequence selected from SEQ ID NOS: 2-14, wherein one or both of the heavy and light chains comprise a CAR-ID disclosed herein (e.g., a GCN4 CAR-ID). In some particular embodiments, the light chain sequence comprises a humanized sequence selected from SEQ ID NOS: 27-34 (which comprise an N-terminal GCN4 CAR-ID) and a heavy chain sequence selected from SEQ ID NOS: 2-14. In some particular embodiments, the light chain sequence comprises a humanized sequence that is at least 85%, 90%, 95%, 96%, 97%, 98%, or at least 99% identical to a sequence selected from SEQ ID NOS: 27-34 (which comprise an N-terminal GCN4 CAR-ID) and a heavy chain sequence that is at least 85%, 90%, 95%, 96%, 97%, 98%, or at least 99% identical to a sequence selected from SEQ ID NOS: 2-14. In some particular embodiments, the switch is a switch described in Table 6 or Table 8, which presents heavy chain/light chain combinations comprised in several of the switches disclosed herein. In some embodiments, the switch is identical to a switch described in Table 6 or Table 8, except that the CAR-ID comprised in the switch is modified to have a sequence of Structure I. In some embodiments, the sequence of Structure I is selected from any one of SEQ ID NOS: 26, 36, 139, and 154-163. The pharmaceutical composition may comprise a single switch. The pharmaceutical composition may comprise a plurality of switches. The plurality of switches may each comprise the same CAR-ID. Two or more of the plurality of switches may each comprise a different CAR-ID. The plurality of switches may each be bound by the same CAR on a CAR-EC. The CAR-ID may be a GCN4 derivative disclosed herein.

Pharmaceutically acceptable salts, excipients, or vehicles for use in the present pharmaceutical compositions include carriers, excipients, diluents, antioxidants, preservatives, coloring, flavoring and diluting agents, emulsifying agents, suspending agents, solvents, fillers, bulking agents, buffers, delivery vehicles, tonicity agents, cosolvents, wetting agents, complexing agents, buffering agents, antimicrobials, and surfactants.

Neutral buffered saline or saline mixed with serum albumin are exemplary appropriate carriers. The pharmaceutical compositions may include antioxidants such as ascorbic acid; low molecular weight polypeptides; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as Tween, pluronics, or polyethylene glycol (PEG). Also by way of example, suitable tonicity enhancing agents include alkali metal halides (preferably sodium or potassium chloride), mannitol, sorbitol, and the like. Suitable preservatives include benzalkonium chloride, thimerosal, phenethyl alcohol, methylparaben, propylparaben, chlorhexidine, sorbic acid and the like. Hydrogen peroxide also may be used as preservative. Suitable cosolvents include glycerin, propylene glycol, and PEG. Suitable complexing agents include caffeine, polyvinylpyrrolidone, beta-cyclodextrin or hydroxy-propyl-beta-cyclodextrin. Suitable surfactants or wetting agents include sorbitan esters, polysorbates such as polysorbate 80, tromethamine, lecithin, cholesterol, tyloxapal, and the like. The buffers may be conventional buffers such as acetate, borate, citrate, phosphate, bicarbonate, or TRIS®-HCl. Acetate buffer may be about pH 4-5.5, and TRIS® buffer may be about pH 7-8.5. Additional pharmaceutical agents are set forth in Remington's Pharmaceutical Sciences, 18th Edition, A. R. Gennaro, ed., Mack Publishing Company, 1990.

The composition may be in liquid form or in a lyophilized or freeze-dried form and may include one or more lyoprotectants, excipients, surfactants, high molecular weight structural additives and/or bulking agents (see, for example, U.S. Pat. Nos. 6,685,940, 6,566,329, and 6,372,716). In one embodiment, a lyoprotectant is included, which is a non-reducing sugar such as sucrose, lactose or trehalose. The amount of lyoprotectant generally included is such that, upon reconstitution, the resulting formulation will be isotonic, although hypertonic or slightly hypotonic formulations also may be suitable. In addition, the amount of lyoprotectant should be sufficient to prevent an unacceptable amount of degradation and/or aggregation of the protein upon lyophilization. Exemplary lyoprotectant concentrations for sugars (e.g., sucrose, lactose, trehalose) in the pre-lyophilized formulation are from about 10 mM to about 400 mM. In another embodiment, a surfactant is included, such as for example, nonionic surfactants and ionic surfactants such as polysorbates (e.g., polysorbate 20, polysorbate 80); poloxamers (e.g., poloxamer 188); poly(ethylene glycol) phenyl ethers (e.g., Triton); sodium dodecyl sulfate (SDS); sodium laurel sulfate; sodium octyl glycoside; lauryl-, myristyl-, linoleyl-, or stearyl-sulfobetaine; lauryl-, myristyl-, linoleyl- or stearyl-sarcosine; linoleyl, myristyl-, or cetyl-betaine; lauroamidopropyl-, cocamidopropyl-, linoleamidopropyl-, myristamidopropyl-, palmidopropyl-, or isostearamidopropyl-betaine (e.g., lauroamidopropyl); myristamidopropyl-, palmidopropyl-, or isostearamidopropyl-dimethylamine; sodium methyl cocoyl-, or disodium methyl ofeyl-taurate; and the MONAQUAT™ series (Mona Industries, Inc., Paterson, N.J.), polyethyl glycol, polypropyl glycol, and copolymers of ethylene and propylene glycol (e.g., Pluronics, PF68 etc). Exemplary amounts of surfactant that may be present in the pre-lyophilized formulation are from about 0.001-0.5%. High molecular weight structural additives (e.g., fillers, binders) may include for example, acacia, albumin, alginic acid, calcium phosphate (dibasic), cellulose, carboxymethylcellulose, carboxymethylcellulose sodium, hydroxyethylcellulose, hydroxypropylcellulose, hydroxypropylmethylcellulose, microcrystalline cellulose, dextran, dextrin, dextrates, sucrose, tylose, pregelatinized starch, calcium sulfate, amylose, glycine, bentonite, maltose, sorbitol, ethylcellulose, disodium hydrogen phosphate, disodium phosphate, disodium pyrosulfite, polyvinyl alcohol, gelatin, glucose, guar gum, liquid glucose, compressible sugar, magnesium aluminum silicate, maltodextrin, polyethylene oxide, polymethacrylates, povidone, sodium alginate, tragacanth microcrystalline cellulose, starch, and zein. Exemplary concentrations of high molecular weight structural additives are from 0.1% to 10% by weight. In other embodiments, a bulking agent (e.g., mannitol, glycine) may be included.

Compositions may be sterile. Compositions may be pyrogen-free or substantially pyrogen-free. Compositions may be endotoxin-free or substantially endotoxin-free. Compositions may be isotonic aqueous solutions. Compositions may contain pharmaceutically acceptable preservatives.

Compositions may be suitable for parenteral administration. Exemplary compositions are suitable for injection or infusion into an animal by any route available to the skilled worker, such as intraarticular, subcutaneous, intravenous, intramuscular, intraperitoneal, intracerebral (intraparenchymal), intracerebroventricular, intramuscular, intraocular, intraarterial, or intralesional routes. A parenteral formulation typically will be a sterile, pyrogen-free, isotonic aqueous solution, optionally containing pharmaceutically acceptable preservatives.

Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringers' dextrose, dextrose and sodium chloride, lactated Ringer's, or fixed oils. Intravenous vehicles include fluid and nutrient replenishers, electrolyte replenishers, such as those based on Ringer's dextrose, and the like. Preservatives and other additives may also be present, such as, for example, anti-microbials, anti-oxidants, chelating agents, inert gases and the like. See generally, Remington's Pharmaceutical Science, 16th Ed., Mack Eds., 1980, incorporated herein by reference in its entirety.

Pharmaceutical compositions described herein may be formulated for controlled or sustained delivery in a manner that provides local concentration of the product (e.g., bolus, depot effect) and/or increased stability or half-life in a particular local environment. The compositions may comprise the formulation of Switches, polypeptides, nucleic acids, or vectors disclosed herein with particulate preparations of polymeric compounds such as polylactic acid, polyglycolic acid, etc., as well as agents such as a biodegradable matrix, injectable microspheres, microcapsular particles, microcapsules, bioerodible particles beads, liposomes, and implantable delivery devices that provide for the controlled or sustained release of the active agent which then may be delivered as a depot injection. Techniques for formulating such sustained- or controlled-delivery means are known and a variety of polymers have been developed and used for the controlled release and delivery of drugs. Such polymers are typically biodegradable and biocompatible. Polymer hydrogels, including those formed by complexation of enantiomeric polymer or polypeptide segments, and hydrogels with temperature or pH sensitive properties, may be desirable for providing drug depot effect because of the mild and aqueous conditions involved in trapping bioactive protein agents (e.g., antibodies comprising an ultralong CDR3). See, for example, the description of controlled release porous polymeric microparticles for the delivery of pharmaceutical compositions in WO 93/15722. Suitable materials for this purpose include polylactides (see, e.g., U.S. Pat. No. 3,773,919), polymers of poly-(a-hydroxycarboxylic acids), such as poly-D-(-)-3-hydroxybutyric acid (EP 133,988A), copolymers of L-glutamic acid and gamma ethyl-L-glutamate (Sidman et al., Biopolymers, 22: 547-556 (1983)), poly(2-hydroxyethyl-methacrylate) (Langer et al., J. Biomed. Mater. Res., 15: 167-277 (1981), and Langer, Chem. Tech., 12: 98-105 (1982)), ethylene vinyl acetate, or poly-D(-)-3-hydroxybutyric acid. Other biodegradable polymers include poly(lactones), poly(acetals), poly(orthoesters), and poly(orthocarbonates). Sustained-release compositions also may include liposomes, which may be prepared by any of several methods known in the art (see, e.g., Eppstein et al., Proc. Natl. Acad. Sci. USA, 82: 3688-92 (1985)). The carrier itself, or its degradation products, should be nontoxic in the target tissue and should not further aggravate the condition. This may be determined by routine screening in animal models of the target disorder or, if such models are unavailable, in normal animals. Microencapsulation of recombinant proteins for sustained release has been performed successfully with human growth hormone (rhGH), interferon-(rhIFN-), interleukin-2, and MN rgp120. Johnson et al., Nat. Med., 2:795-799 (1996); Yasuda, Biomed. Ther., 27:1221-1223 (1993); Hora et al., Bio/Technology. 8:755-758 (1990); Cleland, "Design and Production of Single Immunization Vaccines Using Polylactide Polyglycolide Microsphere Systems," in Vaccine Design: The Subunit and Adjuvant Approach, Powell and Newman, eds, (Plenum Press: New York, 1995), pp. 439-462; WO 97/03692, WO 96/40072, WO 96/07399; and U.S. Pat. No. 5,654,010. The sustained-release formulations of these proteins were developed using poly-lactic-coglycolic acid (PLGA) polymer due to its biocompatibility and wide range of biodegradable properties. The degradation products of PLGA, lactic and glycolic acids may be cleared quickly within the human body. Moreover, the degradability of this polymer may be depending on its molecular weight and composition. Lewis, "Controlled release of bioactive agents from lactide/glycolide polymer," in: M. Chasin and R. Langer (Eds.), Biodegradable Polymers as Drug Delivery Systems (Marcel Dekker: New York, 1990), pp. 1-41. Additional examples of sustained release compositions include, for example, EP 58,481A, U.S. Pat. No. 3,887,699, EP 158,277A, Canadian Patent No. 1176565, U. Sidman et al., Biopolymers 22, 547 [1983], R. Langer et al., Chem. Tech. 12, 98 [1982], Sinha et al., J. Control. Release 90, 261 [2003], Zhu et al., Nat. Biotechnol. 18, 24 [2000], and Dai et al., Colloids Surf B Biointerfaces 41, 117 [2005].

Bioadhesive polymers are also contemplated for use in or with compositions of the present disclosure. Bioadhesives are synthetic and naturally occurring materials able to adhere to biological substrates for extended time periods. For example, carbopol and polycarbophil are both synthetic cross-linked derivatives of poly(acrylic acid). Bioadhesive delivery systems based on naturally occurring substances include for example hyaluronic acid, also known as hyaluronan. Hyaluronic acid is a naturally occurring mucopolysaccharide consisting of residues of D-glucuronic and N-acetyl-D-glucosamine. Hyaluronic acid is found in the extracellular tissue matrix of vertebrates, including in connective tissues, as well as in synovial fluid and in the vitreous and aqueous humor of the eye. Esterified derivatives of hyaluronic acid have been used to produce microspheres for use in delivery that are biocompatible and biodegradable (see, for example, Cortivo et al., Biomaterials (1991) 12:727-730; EP 517,565; WO 96/29998; Illum et al., J. Controlled Rel. (1994) 29:133-141).

Both biodegradable and non-biodegradable polymeric matrices may be used to deliver compositions of the present disclosure, and such polymeric matrices may comprise natural or synthetic polymers. Biodegradable matrices are preferred. The period of time over which release occurs is based on selection of the polymer. Typically, release over a period ranging from between a few hours and three to twelve months is most desirable. Exemplary synthetic polymers which may be used to form the biodegradable delivery system include: polymers of lactic acid and glycolic acid, polyamides, polycarbonates, polyalkylenes, polyalkylene glycols, polyalkylene oxides, polyalkylene terepthalates, polyvinyl alcohols, polyvinyl ethers, polyvinyl esters, polyvinyl halides, polyvinylpyrrolidone, polyglycolides, polysiloxanes, polyanhydrides, polyurethanes and co-polymers thereof, poly(butic acid), poly(valeric acid), alkyl cellulose, hydroxyalkyl celluloses, cellulose ethers, cellulose esters, nitro celluloses, polymers of acrylic and methacrylic esters, methyl cellulose, ethyl cellulose, hydroxypropyl cellulose, hydroxypropyl methyl cellulose, hydroxybutyl methyl cellulose, cellulose acetate, cellulose propionate, cellulose acetate butyrate, cellulose acetate phthalate, carboxylethyl cellulose, cellulose triacetate, cellulose sulphate sodium salt, poly(methyl methacrylate), poly(ethyl methacrylate), poly(butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), poly(octadecyl acrylate), polyethylene, polypropylene, poly (ethylene glycol), poly(ethylene oxide), poly(ethylene terephthalate), poly(vinyl alcohols), polyvinyl acetate, poly vinyl chloride, polystyrene and polyvinylpyrrolidone. Exemplary natural polymers include alginate and other polysaccharides including dextran and cellulose, collagen, chemical derivatives thereof (substitutions, additions of chemical groups, for example, alkyl, alkylene, hydroxylations, oxidations, and other modifications routinely made by those skilled in the art), albumin and other hydrophilic proteins, zein and other prolamines and hydrophobic proteins, copolymers and mixtures thereof. In general, these materials degrade either by enzymatic hydrolysis or exposure to water in vivo, by surface or bulk erosion. The polymer optionally is in the form of a hydrogel (see, for example, WO 04/009664, WO 05/087201, Sawhney, et al., Macromolecules, 1993, 26, 581-587) that can absorb up to about 90% of its weight in water and further, optionally is cross-linked with multivalent ions or other polymers.

Delivery systems also include non-polymer systems that are lipids including sterols such as cholesterol, cholesterol esters and fatty acids or neutral fats such as mono-di- and tri-glycerides; hydrogel release systems; silastic systems; peptide based systems; wax coatings; compressed tablets using conventional binders and excipients; partially fused implants; and the like. Specific examples include, but are not limited to: (a) erosional systems in which the product is contained in a form within a matrix such as those described in U.S. Pat. Nos. 4,452,775, 4,675,189 and 5,736,152 and (b) diffusional systems in which a product permeates at a controlled rate from a polymer such as described in U.S. Pat. Nos. 3,854,480, 5,133,974 and 5,407,686. Liposomes containing the product may be prepared by methods known methods, such as for example (DE 3,218,121; Epstein et al., Proc. Natl. Acad. Sci. USA, 82: 3688-3692 (1985); Hwang et al., Proc. Natl. Acad. Sci. USA, 77: 4030-4034 (1980); EP 52,322; EP 36,676; EP 88,046; EP 143,949; EP 142,641; JP 83-118008; U.S. Pat. Nos. 4,485,045 and 4,544,545; and EP 102,324).

Alternatively or additionally, the compositions may be administered locally via implantation into the affected area of a membrane, sponge, or other appropriate material on to which a switch disclosed herein has been absorbed or encapsulated. Where an implantation device is used, the device may be implanted into any suitable tissue or organ, and delivery of a switch, nucleic acid, or vector disclosed herein may be directly through the device via bolus, or via continuous administration, or via catheter using continuous infusion.

A pharmaceutical composition comprising a CAR-EC switch disclosed herein (e.g., a CAR-EC comprising a humanized anti-CD19 antibody, or a CD19 binding fragment thereof, and/or a CAR-EC comprising a GCN4 derivative disclosed herein) may be formulated for inhalation, such as for example, as a dry powder. Inhalation solutions also may be formulated in a liquefied propellant for aerosol delivery. In yet another formulation, solutions may be nebulized. Additional pharmaceutical composition for pulmonary administration include, those described, for example, in WO 94/20069, which discloses pulmonary delivery of chemically modified proteins. For pulmonary delivery, the particle size should be suitable for delivery to the distal lung. For example, the particle size may be from 1 µm to 5 µm; however, larger particles may be used, for example, if each particle is fairly porous.

Certain formulations containing CAR-EC switches disclosed herein (e.g., the humanized anti-CD19 CAR-EC switches) may be administered orally. Formulations administered in this fashion may be formulated with or without those carriers customarily used in the compounding of solid dosage forms such as tablets and capsules. For example, a capsule may be designed to release the active portion of the formulation at the point in the gastrointestinal tract when bioavailability is maximized and pre-systemic degradation is minimized. Additional agents may be included to facilitate absorption of a selective binding agent. Diluents, flavorings, low melting point waxes, vegetable oils, lubricants, suspending agents, tablet disintegrating agents, and binders also may be employed.

Another preparation may involve an effective quantity of a CAR-EC switch disclosed herein (e.g., an anti-CD19 CAR-EC such as a humanized anti-CD19 CAR-EC and/or a CAR-EC comprising a GCN4 derivative disclosed herein) in a mixture with non-toxic excipients which are suitable for the manufacture of tablets. By dissolving the tablets in sterile water, or another appropriate vehicle, solutions may be prepared in unit dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Suitable and/or preferred pharmaceutical formulations may be determined in view of the present disclosure and general knowledge of formulation technology, depending upon the intended route of administration, delivery format, and desired dosage. Regardless of the manner of administration, an effective dose may be calculated according to patient body weight, body surface area, or organ size. Further refinement of the calculations for determining the appropriate dosage for treatment involving each of the formulations described herein are routinely made in the art and is within the ambit of tasks routinely performed in the art. Appropriate dosages may be ascertained through use of appropriate dose-response data.

V. Targets

Disclosed herein are chimeric receptors and chimeric receptor switches that interact with a cell surface molecule on a target cell. Generally, binding of the effector cell and the target cell to the switch brings the target cell into proximity with the effector cell sufficiently close for an activity of the effector cell to have an effect on the target cell.

In some embodiments, the proximity between the target cell and the effector cell is optimized according to a method disclosed in PCT/US2016/027997 or PCT/US2016/027990, each of which is incorporated herein by reference in its entirety.

For example, in some embodiments, the size of any linker connecting the CAR-ID to the targeting moiety may be modified by increasing or decreasing its length, so as to optimize the proximity between the target cell and the effector cell. Further, the location of the CAR-ID on the targeting moiety may be varied to optimize the proximity between the target cell and the effector cell.

In various embodiments, when the effector cell (e.g., T cell) and the target cell are bound to the switch, the T cell may produce an immune response that has a cytotoxic effect on the target cell.

The switches may interact with a plurality of target cells that express CD19. The target cell may be an infected cell. The target cell may be a pathogenically infected cell. The target cell may be a diseased cell. The target cell may be a genetically-modified cell. The target cell may not be a host cell. Further disclosed herein are CAR-EC switches that interact with a molecule on a non-cell target. The non-cell target may be a virus or a portion thereof. The non-cell target may be a fragment of a cell. The non-cell target may be an extracellular matrix component or protein.

The target cell may be derived from a tissue. The tissue may be selected from brain, esophagus, breast, colon, lung, glia, ovary, uterus, testes, prostate, gastrointestinal tract, bladder, liver, thymus, bone and skin. The target cell may be derived from one or more endocrine glands. Alternatively, or additionally, the target cell may be derived from one or more endocrine glands. The endocrine gland may be a lymph gland, pituitary gland, thyroid gland, parathyroid gland, pancreas, gonad or pineal gland.

The target cell may be selected from a stem cell, a pluripotent cell, a hematopoietic stem cell or a progenitor cell. The target cell may a circulating cell. The target cell may be an immune cell.

The target cell may be a cancer stem cell. The target cell may be a cancer cell. The cancer cell may be derived from a tissue. The tissue may be selected from, by way of non-limiting example, a brain, an esophagus, a breast, a colon, a lung, a glia, an ovary, a uterus, a testicle, a prostate, a gastrointestinal tract, a bladder, a liver, a thyroid and skin. The cancer cell may be derived from bone. The cancer cell may be derived from blood. The cancer cell may be derived from a B cell, a T cell, a monocyte, a thrombocyte, a leukocyte, a neutrophil, an eosinophil, a basophil, a lymphocyte, a hematopoietic stem cell or an endothelial cell progenitor. The cancer cell be derived from a CD19-positive B lymphocyte. The cancer cell may be derived from a stem cell. The cancer cell may be derived from a pluripotent cell. The cancer cell may be derived from one or more endocrine glands. The endocrine gland may be a lymph gland, pituitary gland, thyroid gland, parathyroid gland, pancreas, gonad or pineal gland.

The target cell may be selected from a stem cell, a pluripotent cell, a hematopoietic stem cell or a progenitor cell. The target cell may a circulating cell. The target cell may be an immune cell.

The target cell may be a cancer stem cell. The target cell may be a cancer cell. The cancer cell may be derived from a tissue. The tissue may be selected from, by way of non-limiting example, a brain, an esophagus, a breast, a colon, a lung, a glia, an ovary, a uterus, a testicle, a prostate, a gastrointestinal tract, a bladder, a liver, a thyroid and skin. The cancer cell may be derived from bone. The cancer cell may be derived from blood. The cancer cell may be derived from a B cell, a T cell, a monocyte, a thrombocyte, a leukocyte, a neutrophil, an eosinophil, a basophil, a lymphocyte, a hematopoietic stem cell or an endothelial cell progenitor. The cancer cell may be derived from a CD19-positive B lymphocyte. The cancer cell may be derived from a stem cell. The cancer cell may be derived from a pluripotent cell. The cancer cell may be derived from one or more endocrine glands. The endocrine gland may be a lymph gland, pituitary gland, thyroid gland, parathyroid gland, pancreas, gonad or pineal gland.

The cancer cell may be a CD19-positive cell. The cancer cell may be a CD19-positive B lymphocyte. The cancer cell may be a Her2-positive cell. The Her2-positive cell may be a Her2-positive breast cancer cell. The Her2-positive cell may be a Her2-positive pancreatic cancer cell. The cancer cell may be a BCMA-positive cell. The cancer cell may be a BCMA-positive multiple myeloma cell. The cancer cell may be a CS1-positive cell. The CS1-positive cell may be a multiple myeloma cell. The cancer cell may be a EGFRvIII-positive cell. The EGFRvIII-positive cell may be a glioblastoma cell. The cancer cell may be a CD20-positive cell. The cancer cell may be a CD22-positive cell. The cancer cell may be a CD33-positive cell. The CD33-positive cell may be an acute myeloid leukemia cell. The cancer cell may be a CD123-positive cell. The CD123-positive cell may be an acute myeloid leukemia cell. The cancer cell may be a CLL1-positive cell. The CD123-positive cell may be an acute lymphoid leukemia cell. The CLL1-positive cell may be an acute myeloid leukemia cell. The cancer cell may be an acute myeloid leukemia cell that is (i) CD33-positive, (ii) CD123-positive, (iii) CLL1-positive; or (iv) a combination of two or more of (i), (ii) and (iii).

The cell surface molecule may be an antigen. The antigen may be at least a portion of a surface antigen or a cell surface marker on a cell. The antigen may be a receptor or a co-receptor on a cell. The antigen may refer to a molecule or molecular fragment that may be bound by a major histocompatibility complex (MHC) and presented to a T-cell receptor. The term "antigen" may also refer to an immunogen. The immunogen may provoke an adaptive immune response if injected on its own into a subject. The immunogen may induce an immune response by itself. The antigen may be a superantigen, T-dependent antigen or a T-independent antigen. The antigen may be an exogenous antigen. Exogenous antigens are typically antigens that have entered the body from the outside, for example by inhalation, ingestion, or injection. Some antigens may start out as exogenous antigens, and later become endogenous (for example, intracellular viruses). The antigen may be an endogenous antigen. The endogenous antigen may be an antigen that has been generated within cells as a result of normal cell metabolism, or because of pathogenic infections (e.g., viral, bacterial, fungal, parasitic). The antigen may be an autoantigen. The autoantigen may be a normal protein or complex of proteins (and sometimes DNA or RNA) that is recognized by the immune system of patients suffering from a specific autoimmune disease. These antigens should, under normal conditions, not be the target of the immune system, but, due to genetic and/or environmental factors, the normal immunological tolerance for such an antigen is not present in these patients. The antigen may be present or over-expressed due to a condition or disease. The condition or disease may be a cancer or a leukemia. The condition may be an inflammatory disease or condition. The condition or disease may be a metabolic disease. The condition may be a genetic disorder.

The cell surface molecule may be an antigen that has been designated as a tumor antigen. Tumor antigens or neoantigens may be antigens that are presented by MHC I or MHC II molecules on the surface of tumor cells. These antigens may sometimes be presented by tumor cells and never by the normal ones. In this case, they are called tumor-specific antigens (TSAs) and, in general, result from a tumor-specific mutation. More common are antigens that are presented by tumor cells and normal cells, and they are called tumor-associated antigens (TAAs). Cytotoxic T lymphocytes that recognize these antigens may be able to destroy the tumor cells before they proliferate or metastasize. Tumor antigens may also be on the surface of the tumor in the form of, for example, a mutated receptor, in which case they may be recognized by B cells. Unless otherwise specified, the terms "tumor antigen," "tumor specific antigen" and "tumor associated antigen," are used interchangeably herein.

The cell surface molecule may be a receptor. The receptor may be an extracellular receptor. The receptor may be a cell surface receptor. By way of non-limiting example, the receptor may bind a hormone, a neurotransmitter, a cytokine, a growth factor or a cell recognition molecule. The receptor may be a transmembrane receptor. The receptor may be an enzyme-linked receptor. The receptor may be a G-protein couple receptor (GPCR). The receptor may be a growth factor receptor. By way of non-limiting example, the growth factor receptor may be selected from an epidermal growth factor receptor, a fibroblast growth factor receptor, a platelet derived growth factor receptor, a nerve growth factor receptor, a transforming growth factor receptor, a bone morphogenic protein growth factor receptor, a hepatocyte growth factor receptor, a vascular endothelial growth factor receptor, a stem cell factor receptor, an insulin growth factor receptor, a somatomedin receptor, an erythropoietin receptor and homologs and fragments thereof. The receptor may be a hormone receptor. The receptor may be an insulin receptor. By way of non-limiting example, the receptor may be selected from an eicosanoid receptor, a prostaglandin receptor, an estrogen receptor, a follicle stimulating hormone receptor, a progesterone receptor, a growth hormone receptor, a gonadotropin-releasing hormone receptor, homologs thereof and fragments thereof. The receptor may be an adrenergic receptor. The receptor may be an integrin. The receptor may be an Eph receptor. The receptor may be a luteinizing hormone receptor. The cell surface molecule may be at least about 50% homologous to a luteinizing hormone receptor. The receptor may be an immune receptor. By way of non-limiting example, the immune receptor may be selected from a pattern recognition receptor, a toll-like receptor, a NOD like receptor, a killer activated receptor, a killer inhibitor receptor, an Fc receptor, a B cell receptor, a complement receptor, a chemokines receptor and a cytokine receptor. By way of non-limiting example, the cytokine receptor may be selected from an interleukin receptor, an interferon receptor, a transforming growth factor receptor, a tumor necrosis factor receptor, a colony stimulating factor receptor, homologs thereof and fragments thereof. The receptor may be a receptor kinase. The receptor kinase may be a tyrosine kinase receptor. The receptor kinase may be a serine kinase receptor. The receptor kinase may be a threonine kinase receptor. By way of non-limiting example, the receptor kinase may activate a signaling protein selected from a Ras, a Raf, a PI3K, a protein kinase A, a protein kinase B, a protein kinase C, an AKT, an AMPK, a phospholipase, homologs thereof and fragments thereof. The receptor kinase may activate a MAPK/ERK signaling pathway. The receptor kinase may activate Jak, Stat or Smad.

The cell surface molecule may be a non-receptor cell surface protein. The cell surface molecule may be a cluster of differentiation proteins. By way of non-limiting example, the cell surface molecule may be selected from CD34, CD31, CD117, CD45, CD11b, CD15, CD24, CD114, CD182, CD14, CD11a, CD91, CD16, CD3, CD4, CD25, CD8, CD38, CD22, CD61, CD56, CD30, CD13, CLL1, CD33, CD123, CD19, CD20, fragments thereof, and homologs thereof.

The cell surface molecule may be a molecule that does not comprise a peptide. The cell surface molecule may comprise a lipid. The cell surface molecule may comprise a lipid moiety or a lipid group. The lipid moiety may comprise a sterol. The lipid moiety may comprise a fatty acid. The antigen may comprise a glycolipid. The cell surface molecule may comprise a carbohydrate.

Disclosed herein are CAR-EC switches comprising (a) a chimeric antigen receptor binding peptidic antigen comprising a peptide from a yeast transcription factor peptide; and (b) a targeting polypeptide. The yeast transcription factor peptide may be a GCN4 peptide. The targeting polypeptide may comprise a targeting antibody or antibody fragment. The targeting antibody or antibody fragment may comprise a heavy chain of an antibody. The targeting antibody or antibody fragment may comprise a light chain of an antibody. The targeting antibody or antibody fragment may comprise a Fab of an antibody. The targeting antibody or antibody fragment may comprise an anti-CD19 antibody or a fragment thereof. The targeting antibody or antibody fragment may comprise an anti-Her2 antibody or a fragment thereof. The targeting antibody or antibody fragment may be selected from an anti-CS1 antibody, an anti-BCMA antibody, an anti-EGFRvIII antibody, an anti-CD20 antibody, an anti-EGFR antibody, an anti-CEA antibody, an anti-CLL1 antibody, an anti-CD33 antibody, an anti CD123 antibody, and fragments thereof.

Further disclosed herein are CAR-EC switches comprising (a) a CAR binding region comprising a hydrophilic target peptide (HTP) tag; and (b) a targeting polypeptide. The targeting polypeptide may comprise a targeting antibody or antibody fragment. The targeting antibody or antibody fragment may comprise a heavy chain of an antibody. The targeting antibody or antibody fragment may comprise a light chain of an antibody. The targeting antibody or antibody fragment may comprise a Fab of an antibody. The targeting antibody or antibody fragment may comprise an anti-CD19 antibody or a fragment thereof. The targeting antibody or antibody fragment may comprise an anti-Her2 antibody or a fragment thereof. The targeting antibody or antibody fragment may be selected from an anti-CS1 antibody, an anti-BCMA antibody, an anti-EGFRvIII antibody, an anti-CD20 antibody, an anti-EGFR antibody, an anti-CEA antibody, an anti-CLL1 antibody, an anti-CD33 antibody, and anti CD123 antibody, and fragments thereof.

The target (e.g., CD19) may be present or over-expressed on the cell surface of a target cell. The target (e.g., CD19) may be present or over-expressed due to a disease or condition. The disease or condition may be a cancer or leukemia. The disease or condition may be an inflammatory disease or condition. The disease or condition may be a metabolic disease. The disease or condition may be a genetic disorder.

VI. Chimeric Receptors

Disclosed herein are chimeric receptor effector cell switches (CAR-EC) switches that regulate the activities of a cell expressing a chimeric receptor. As used herein, the terms "chimeric receptor" and "chimeric antigen receptor" (CAR) are used interchangeably (despite the fact that the term chimeric "antigen" receptor implies the extracellular portion is an antibody or an antigen-binding portion thereof), as are the terms "chimeric receptor effector cell" and "chimeric antigen receptor effector cell". The chimeric antigen receptor may comprise an extracellular domain, transmembrane domain and intracellular domain. In some embodiments, the chimeric antigen receptor may comprise an extracellular domain, a hinge, a transmembrane domain and intracellular domain. Thus, the terms "chimeric antigen receptor" and "CAR" may in some embodiments encompass chimeric receptors that do not comprise an antibody extracellular domain and the terms may in some embodiments encompass chimeric receptors comprising an extracellular domain that comprises or consists of an antibody or an antigen binding portion thereof.

Disclosed herein are CAR-EC switches that regulate the activities of a cell expressing a chimeric antigen receptor (CAR). The present disclosure provides chimeric antigen receptors, the activity of which are regulated by CAR-EC switches. The chimeric antigen receptor may comprise an extracellular domain, transmembrane domain and intracellular domain. The extracellular domain may bind to the CAR-ID (e.g., a GCN4, Flag, K4, or E4 peptide, or a small molecule such as FITC) of the CAR-EC switch.

The CAR may be humanized to reduce immunogenicity to humans. The CAR may comprise an extracellular domain that is humanized. The humanization may reduce immunogenicity of the CAR to humans while retaining the specificity and affinity of the extracellular domain for the CAR-EC switch. The CAR may be a humanized version of any one of the CAR sequences provided in Table 13 or it may be a humanized version of any one of SEQ ID NOS: 270-289. The CAR may comprise a humanized sequence that is at least 85%, 90%, 95%, 96%, 97%, 98%, or at least 99% identical to any one of the CAR sequences provided in Table 13 or it may comprise a humanized sequence that is at least 85%, 90%, 95%, 96%, 97%, 98%, or at least 99% identical to SEQ ID NOS: 270-289.

TABLE 13

Murine sCAR sequences

| Sequence | Seq id no | Name |
|---|---|---|
| MGVPTQLLGLLLLWITDAICDIQMTQSPASLSTSLGETVTIQCQASE DIYSGLAWYQQKPGKSPQLLIYGASDLQDGVPSRFSGSGSGTQYSLK ITSMQTEDEGVYFCQQGLTYPRTFGGGTKLELKGGGGSGGGGSGGGG SEVQLQQSGAELVRPGTSVKLSCKVSGDTITFYYMHFVKQRPGQGLE WIGRIDPEDESTKYSEKFKNKATLTADTSSNTAYLKLSSLTSEDTAT YFCIYGGYYFDYWGQGVMVTVSSIEFMYPPPYLDNERSNGTIIHIKE KHLCHTQSSPKLFWALVVVAGVLFCYGLLVTVALCVIWTNSRRNRGG QSDYMNMTPRRPGLTRKPYQPYAPARDFAAYRPRAKFSRSAETAANL QDPNQLFNELNLGRREEFDVLEKKRARDPEMGGKQQRRRNPQEGVYN ALQKDKMAEAYSEIGTKGERRRGKGHDGLFQGLSTATKDTFDALHMQ TLAPR | 270. | >1D3_CAR |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSIEFMYPPPYLDNERSNGTIIHIKEKHLCHTQSSPKLFWA LVVVAGVLFCYGLLVTVALCVIWTNSRRNRGGQSDYMNMTPRRPGLT RKPYQPYAPARDFAAYRPRAKFSRSAETAANLQDPNQLFNELNLGRR EEFDVLEKKRARDPEMGGKQQRRRNPQEGVYNALQKDKMAEAYSEIG TKGERRRGKGHDGLFQGLSTATKDTFDALHMQTLAPR | 271. | >IH-1-109 |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSESKYGPPCPPCPFWALVVVAGVLFCYGLLVTVALCVIWT NSRRNRGGQSDYMNMTPRRPGLTRKPYQPYAPARDFAAYRPRAKFSR SAETAANLQDPNQLFNELNLGRREEFDVLEKKRARDPEMGGKQQRRR NPQEGVYNALQKDKMAEAYSEIGTKGERRRGKGHDGLFQGLSTATKD TFDALHMQTLAPR | 272. | >SV-285-064 |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSESKYGPPCPPCPFWALVVVAGVLFCYGLLVTVALCVIWT KWIRKKFPHIFKQPFKKTTGAAQEEDACSCRCPQEEEGGGGGYELRA KFSRSAETAANLQDPNQLFNELNLGRREEFDVLEKKRARDPEMGGKQ QRRRNPQEGVYNALQKDKMAEAYSEIGTKGERRRGKGHDGLFQGLST ATKDTFDALHMQTLAPR | 273. | >SV-319-029 |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSESKYGPPCPPCPFWALVVVAGVLFCYGLLVTVALCVIWT NSRRNRGGQSDYMNMTPRRPGLTRKPYQPYAPARDFAAYRPKWIRKK FPHIFKQPFKKTTGAAQEEDACSCRCPQEEEGGGGGYELRAKFSRSA ETAANLQDPNQLFNELNLGRREEFDVLEKKRARDPEMGGKQQRRRNP QEGVYNALQKDKMAEAYSEIGTKGERRRGKGHDGLFQGLSTATKDTF DALHMQTLAPR | 274. | >SV-319-028 |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSESKYGPPCPPCPFWALVVVAGVLFCYGLLVTVALCVIWT NSRRNRGGQSDYMNMTPRRPGLTRKPYQPYAPARDFAAYRPRAKFSR SAETAANLQDPNQLYNELNLGRREEYDVLEKKRARDPEMGGKQQRRR NPQEGVYNALQKDKMAEAYSEIGTKGERRRGKGHDGLYQGLSTATKD TYDALHMQTLAPR | 275. | >SV-319-090 |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSESKYGPPCPPCPFWALVVVAGVLFCYGLLVTVALCVIWT KWIRKKFPHIFKQPFKKTTGAAQEEDACSCRCPQEEEGGGGGYELRA | 276. | >SV-319-091 |

TABLE 13-continued

| Murine sCAR sequences | | |
|---|---|---|
| Sequence | Seq id no | Name |
| KFSRSAETAANLQDPNQLYNELNLGRREEYDVLEKKRARDPEMGGKQ<br>QRRRNPQEGVYNALQKDKMAEAYSEIGTKGERRRGKGHDGLYQGLST<br>ATKDTYDALHMQTLAPR | | |
| DAVVTQESALTSSPGETVTLTCRSSTGAVTTSNYASWVQEKPDHLFT<br>GLIGGTNNRAPGVPARFSGSLIGDKAALTITGAQTEDEAIYFCVLWY<br>SDHWVFGGGTKLTVLGGGGSGGGGSGGGGSGGGGSDVQLQESGPGL<br>VAPSQSLSITCTVSGFLLTDYGVNWVRQSPGKGLEWLGVIWGDGITD<br>YNSALKSRLSVTKDNSKSQVFLKMNSLQSGDSARYYCVTGLFDYWGQ<br>GTTLTVSSESKYGPPCPPCPFWALVVVAGVLFCYGLLVTVALCVIWT<br>NSRRNGGQSDYMNMTPRRPGLTRKPYQPYAPARDFAAYRPKWIRKK<br>FPHIFKQPFKKTTGAAQEEDACSCRCPQEEEGGGGGYELRAKFSRSA<br>ETAANLQDPNQLYNELNLGRREEYDVLEKKRARDPEMGGKQQRRRNP<br>QEGVYNALQKDKMAEAYSEIGTKGERRRGKGHDGLYQGLSTATKDTY<br>DALHMQTLAPR | 277. | >SV-319-092 |
| DAVVTQESALTSSPGETVTLTCRSSTGAVTTSNYASWVQEKPDHLFT<br>GLIGGTNNRAPGVPARFSGSLIGDKAALTITGAQTEDEAIYFCVLWY<br>SDHWVFGGGTKLTVLGGGGSGGGGSGGGGSGGGGSDVQLQESGPGL<br>VAPSQSLSITCTVSGFLLTDYGVNWVRQSPGKGLEWLGVIWGDGITD<br>YNSALKSRLSVTKDNSKSQVFLKMNSLQSGDSARYYCVTGLFDYWGQ<br>GTTLTVSSTTTKPVLRTPSPVHPTGTSQPQRPEDCRPRGSVKGTGLD<br>FACDIYIWAPLAGICVALLLSLIITLICNSRRNGGQSDYMNMTPRR<br>PGLTRKPYQPYAPARDFAAYRPRAKFSRSAETAANLQDPNQLFNELN<br>LGRREEFDVLEKKRARDPEMGGKQQRRRNPQEGVYNALQKDKMAEAY<br>SEIGTKGERRRGKGHDGLFQGLSTATKDTFDALHMQTLAPR | 278. | >SV-319-162 |
| DAVVTQESALTSSPGETVTLTCRSSTGAVTTSNYASWVQEKPDHLFT<br>GLIGGTNNRAPGVPARFSGSLIGDKAALTITGAQTEDEAIYFCVLWY<br>SDHWVFGGGTKLTVLGGGGSGGGGSGGGGSGGGGSDVQLQESGPGL<br>VAPSQSLSITCTVSGFLLTDYGVNWVRQSPGKGLEWLGVIWGDGITD<br>YNSALKSRLSVTKDNSKSQVFLKMNSLQSGDSARYYCVTGLFDYWGQ<br>GTTLTVSSTTTKPVLRTPSPVHPTGTSQPQRPEDCRPRGSVKGTGLD<br>FACDIYIWAPLAGICVALLLSLIITLICKWIRKKFPHIFKQPFKKTT<br>GAAQEEDACSCRCPQEEEGGGGGYELRAKFSRSAETAANLQDPNQLF<br>NELNLGRREEFDVLEKKRARDPEMGGKQQRRRNPQEGVYNALQKDKM<br>AEAYSEIGTKGERRRGKGHDGLFQGLSTATKDTFDALHMQTLAPR | 279. | >SV-1-003 |
| DAVVTQESALTSSPGETVTLTCRSSTGAVTTSNYASWVQEKPDHLFT<br>GLIGGTNNRAPGVPARFSGSLIGDKAALTITGAQTEDEAIYFCVLWY<br>SDHWVFGGGTKLTVLGGGGSGGGGSGGGGSGGGGSDVQLQESGPGL<br>VAPSQSLSITCTVSGFLLTDYGVNWVRQSPGKGLEWLGVIWGDGITD<br>YNSALKSRLSVTKDNSKSQVFLKMNSLQSGDSARYYCVTGLFDYWGQ<br>GTTLTVSSTTTKPVLRTPSPVHPTGTSQPQRPEDCRPRGSVKGTGLD<br>FACDIYIWAPLAGICVALLLSLIITLICNSRRNGGQSDYMNMTPRR<br>PGLTRKPYQPYAPARDFAAYRPKWIRKKFPHIFKQPFKKTTGAAQEE<br>DACSCRCPQEEEGGGGGYELRAKFSRSAETAANLQDPNQLFNELNLG<br>RREEFDVLEKKRARDPEMGGKQQRRRNPQEGVYNALQKDKMAEAYSE<br>IGTKGERRRGKGHDGLFQGLSTATKDTFDALHMQTLAPR | 280. | >SV-319-163 |
| DAVVTQESALTSSPGETVTLTCRSSTGAVTTSNYASWVQEKPDHLFT<br>GLIGGTNNRAPGVPARFSGSLIGDKAALTITGAQTEDEAIYFCVLWY<br>SDHWVFGGGTKLTVLGGGGSGGGGSGGGGSGGGGSDVQLQESGPGL<br>VAPSQSLSITCTVSGFLLTDYGVNWVRQSPGKGLEWLGVIWGDGITD<br>YNSALKSRLSVTKDNSKSQVFLKMNSLQSGDSARYYCVTGLFDYWGQ<br>GTTLTVSSTTTKPVLRTPSPVHPTGTSQPQRPEDCRPRGSVKGTGLD<br>FACDIYIWAPLAGICVALLLSLIITLICNSRRNGGQSDYMNMTPRR<br>PGLTRKPYQPYAPARDFAAYRPRAKFSRSAETAANLQDPNQLYNELN<br>LGRREEYDVLEKKRARDPEMGGKQQRRRNPQEGVYNALQKDKMAEAY<br>SEIGTKGERRRGKGHDGLYQGLSTATKDTYDALHMQTLAPR | 281. | >SV-319-088 |
| DAVVTQESALTSSPGETVTLTCRSSTGAVTTSNYASWVQEKPDHLFT<br>GLIGGTNNRAPGVPARFSGSLIGDKAALTITGAQTEDEAIYFCVLWY<br>SDHWVFGGGTKLTVLGGGGSGGGGSGGGGSGGGGSDVQLQESGPGL<br>VAPSQSLSITCTVSGFLLTDYGVNWVRQSPGKGLEWLGVIWGDGITD<br>YNSALKSRLSVTKDNSKSQVFLKMNSLQSGDSARYYCVTGLFDYWGQ<br>GTTLTVSSTTTKPVLRTPSPVHPTGTSQPQRPEDCRPRGSVKGTGLD<br>FACDIYIWAPLAGICVALLLSLIITLICKWIRKKFPHIFKQPFKKTT<br>GAAQEEDACSCRCPQEEEGGGGGYELRAKFSRSAETAANLQDPNQLY<br>NELNLGRREEYDVLEKKRARDPEMGGKQQRRRNPQEGVYNALQKDKM<br>AEAYSEIGTKGERRRGKGHDGLYQGLSTATKDTYDALHMQTLAPR | 282. | >SV-1-004 |
| DAVVTQESALTSSPGETVTLTCRSSTGAVTTSNYASWVQEKPDHLFT<br>GLIGGTNNRAPGVPARFSGSLIGDKAALTITGAQTEDEAIYFCVLWY<br>SDHWVFGGGTKLTVLGGGGSGGGGSGGGGSGGGGSDVQLQESGPGL | 283. | >SV-319-089 |

TABLE 13-continued

| Murine sCAR sequences | | |
|---|---|---|
| Sequence | Seq id no | Name |
| VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSTTTKPVLRTPSPVHPTGTSQPQRPEDCRPRGSVKGTGLD FACDIYIWAPLAGICVALLLSLIITLICNSRRNGGQSDYMNMTPRR PGLTRKPYQPYAPARDFAAYRPKWIRKKFPHIFKQPFKKTTGAAQEE DACSCRCPQEEEGGGGYELRAKFSRSAETAANLQDPNQLYNELNLG RREEYDVLEKKRARDPEMGGKQQRRRNPQEGVYNALQKDKMAEAYSE IGTKGERRRGKHDGLYQGLSTATKDTYDALHMQTLAPR | | |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSESKYGPPCPPCPIYIWAPLAGICVALLLSLIITLICNSR RNGGQSDYMNMTPRRPGLTRKPYQPYAPARDFAAYRPRAKFSRSAE TAANLQDPNQLFNELNLGRREEFDVLEKKRARDPEMGGKQQRRRNPQ EGVYNALQKDKMAEAYSEIGTKGERRRGKGHDGLFQGLSTATKDTFD ALHMQTLAPR | 284. | >SV-319-164 |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSESKYGPPCPPCPIYIWAPLAGICVALLLSLIITLICKWI RKKFPHIFKQPFKKTTGAAQEEDACSCRCPQEEEGGGGYELRAKFS RSAETAANLQDPNQLFNELNLGRREEFDVLEKKRARDPEMGGKQQRR RNPQEGVYNALQKDKMAEAYSEIGTKGERRRGKGHDGLFQGLSTATK DTFDALHMQTLAPR | 285. | >SV-1-001 |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSESKYGPPCPPCPIYIWAPLAGICVALLLSLIITLICNSR RNGGQSDYMNMTPRRPGLTRKPYQPYAPARDFAAYRPKWIRKKFPH IFKQPFKKTTGAAQEEDACSCRCPQEEEGGGGYELRAKFSRSAETA ANLQDPNQLFNELNLGRREEFDVLEKKRARDPEMGGKQQRRRNPQEG VYNALQKDKMAEAYSEIGTKGERRRGKGHDGLFQGLSTATKDTFDAL HMQTLAPR | 286. | >SV-319-165 |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSESKYGPPCPPCPIYIWAPLAGICVALLLSLIITLICNSR RNGGQSDYMNMTPRRPGLTRKPYQPYAPARDFAAYRPRAKFSRSAE TAANLQDPNQLYNELNLGRREEYDVLEKKRARDPEMGGKQQRRRNPQ EGVYNALQKDKMAEAYSEIGTKGERRRGKHDGLYQGLSTATKDTYD ALHMQTLAPR | 287. | >SV-319-166 |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSESKYGPPCPPCPIYIWAPLAGICVALLLSLIITLICKWI RKKFPHIFKQPFKKTTGAAQEEDACSCRCPQEEEGGGGYELRAKFS RSAETAANLQDPNQLYNELNLGRREEYDVLEKKRARDPEMGGKQQRR RNPQEGVYNALQKDKMAEAYSEIGTKGERRRGKHDGLYQGLSTATK DTYDALHMQTLAPR | 288. | >SV-1-002 |
| DAVVTQESALTSSPGETVTLTCRSSTGAVTTSNYASWVQEKPDHLFT GLIGGTNNRAPGVPARFSGSLIGDKAALTITGAQTEDEAIYFCVLWY SDHWVFGGGTKLTVLGGGGSGGGGSGGGGSGGGGSDVQLQESGPGL VAPSQSLSITCTVSGFLLTDYGVNWVRQSPGKGLEWLGVIWGDGITD YNSALKSRLSVTKDNSKSQVFLKMNSLQSGDSARYYCVTGLFDYWGQ GTTLTVSSESKYGPPCPPCPIYIWAPLAGICVALLLSLIITLICNSR RNGGQSDYMNMTPRRPGLTRKPYQPYAPARDFAAYRPKWIRKKFPH IFKQPFKKTTGAAQEEDACSCRCPQEEEGGGGYELRAKFSRSAETA | 289. | >SV-319-167 |

TABLE 13-continued

Murine sCAR sequences

| Sequence | Seq id no | Name |
|---|---|---|
| ANLQDPNQLYNELNLGRREEYDVLEKKRARDPEMGGKQQRRRNPQEG VYNALQKDKMAEAYSEIGTKGERRRGKGHDGLYQGLSTATKDTYDAL HMQTLAPR | | |

The extracellular domain may comprise an antibody or antibody fragment that binds to the CAR-ID of the CAR-EC switch (a CAR-antibody). The antibody or antibody fragment may be humanized. The CAR-antibody may comprise at least a portion of an antibody. In some instances, the CAR-antibody is not a full-length antibody. The CAR-antibody may comprise at least a portion of an immunoglobulin or fragment thereof. The immunoglobulin or fragment thereof may be selected from the group consisting of an scFv, a di-scFv, a bi-scFv, a Fab, an Fc, an F(ab')2, a pFc', a nanobody, an affibody, a DARPin, a diabody, a camelid, an engineered T cell receptor and a monobody. The immunoglobulin may be selected from the group consisting of an IgA1, an IgA2, an IgD, an IgM, an IgE, an IgG1, an IgG2, an IgG3, and an IgG4. Such immunoglobulin or fragments thereof may be humanized. The CAR-antibody may comprise at least a portion of a single chain variable fragment (scFv). The portion may be an antigen binding portion. The scFv or humanized scFv may comprise or consist of the general structure light chain-linker-heavy chain. The scFv or humanized scFv may comprise or consist of the general structure heavy chain-linker-light chain. The humanized scFv may comprise a humanized VH (variable heavy chain) sequence with non-human (e.g., murine) CDRs grafted onto a human immunoglobulin framework. The framework may be the IGHJ4-59. The humanized VH sequence may comprise murine CDRs transplanted onto the wildtype IGHJ4-59 framework. The humanized VH sequence may comprise murine CDRs transplanted onto a modified IGHJ4-59 framework comprising one or more framework changes (i.e., amino acid modification such as a substitution). The framework changes may be at position 71 (Kabat H71), position 73 (Kabat H73), position 93 (Kabat H90), position 94 (Kabat H91), or combinations of such positions. The humanized scFV may additionally or alternatively comprise a humanized VL (variable light chain) sequence with non-human (e.g., murine) CDRs transplanted onto a human immunoglobulin light chain framework. The light chain framework may be the IGLV7-46 framework. The humanized VL sequence may comprise murine CDRs transplanted onto the wildtype IGLV7-46 framework. The humanized VL sequence may comprise murine CDRs transplanted onto a modified IGLV7-46 framework comprising one or more framework changes (i.e., amino acid modification such as a substitution). The CAR-antibody may be human, fully human, humanized, human engineered, non-human, and/or chimeric antibody.

The extracellular domain of the CAR may comprise an anti-GCN4 antibody or a GCN4-binding portion thereof. The extracellular domain may comprise a humanized anti-GCN4 scFv (e.g., clone 52SR4, which is a high affinity mutant anti-GCN4 scFv and is described in Zahnd, C., et al., (2004), The Journal of Biological Chemistry 279, 18870-18877 (incorporated herein by reference in its entirety)). The humanized anti-GCN4 scFV (e.g., a humanized version of clone 52SR4) may comprise a humanized light chain, a humanized heavy chain, or a humanized light chain and a humanized heavy chain. The humanized anti-GCN4 (e.g., a humanized version of clone 52SR4) may comprise a humanized VH (variable heavy chain) sequence with non-human (e.g., murine) CDRs transplanted onto a human immunoglobulin framework. The framework may be the IGHJ4-59 framework. The humanized VH sequence may comprise murine CDRs from an anti-GCN4 antibody transplanted onto the wildtype IGHJ4-59 framework. The humanized VH sequence may comprise the CDRs from 52SR4 transplanted onto the wildtype IGHJ4-59 framework. The humanized VH sequence may comprise the CDRs from the 52SR4 antibody transplanted onto a modified IGHJ4-59 framework comprising one or more framework change (i.e., an amino acid modification such as a substitution, deletion or addition). The framework change may affect CDR-H2 conformation, CDR-H3 conformation, improve internal packing of the VH domain and/or may improve binding affinity. The framework change may be at position 71 (Kabat H71), position 73 (Kabat H73), position 93 (Kabat H90), position 94 (Kabat H91), or combinations of such positions. The humanized anti-GCN4 (e.g., a humanized version of clone 52SR4) may additionally or alternatively comprise a humanized VL (variable light chain) sequence with non-human (e.g., murine) CDRs transplanted onto a human immunoglobulin light chain framework. The light chain framework may be the IGLV7-46 framework. The humanized VL sequence may comprise murine CDRs from an anti-GCN4 antibody transplanted onto the wildtype IGLV7-46 framework. The humanized VH sequence may comprise the CDRs from the 52SR4 antibody transplanted onto the wildtype IGLV7-46 framework. The humanized VH sequence may comprise the CDRs from 52SR4 transplanted onto a modified IGLV7-46 framework comprising one or more framework change (i.e., an amino acid modification such as a substitution, deletion or addition). The framework change may result in a sequence with a low propensity for deamidation, may affect CDR conformation, improve internal packing and/or may improve binding affinity. The framework change may be at any position including the positions shown herein, or combinations of such positions. The humanized anti-GCN4 scFV may be encoded by an amino acid sequence selected from SEQ ID NOS: 169-174. The humanized anti-GCN4 scFV may be encoded by a polynucleotide sequence selected from SEQ ID NOS: 175-180. The humanized anti-GCN4 scFV may be encoded by an amino acid sequence that is at least 85%, 90%, 95%, 96%, 97%, 98%, or at least 99% identical to a sequence selected from any one of SEQ ID NOS: 169-174. The humanized anti-GCN4 scFV may be encoded by a polynucleotide sequence that is at least 85%, 90%, 95%, 96%, 97%, 98%, or at least 99% identical to a sequence selected from any one of SEQ ID NOS: 175-180.

The extracellular domain of the CAR may comprise a humanized scFv encoded by any one of the amino acid sequences provided in Tables 14-16, or any one sequence selected from SEQ ID NOS: 290-388, and 423. The extracellular domain of the CAR may comprise a humanized scFv encoded by an amino acid sequence that is at least 85%, 90%, 95%, 96%, 97%, 98%, or at least 99% identical to a sequence provided in any one of Tables 14-16, or an amino acid sequence that is at least 85%, 90%, 95%, 96%, 97%, 98%, or at least 99% identical to a any one of SEQ ID NOS: 290-388, and 423.

In certain embodiments, the extracellular domain of the CAR comprises of a sequence that is at least 50%, at least 60%, at least 70%, at least 80%, at least 85%, at least 90%, at least 95%, at least 96%, at least 97%, at least 98%, or at least 99% identical to SEQ ID NO: 322.

In certain embodiments, the extracellular domain of the CAR consists of a sequence that is at least 50%, at least 60%, at least 70%, at least 80%, at least 85%, at least 90%, at least 95%, at least 96%, at least 97%, at least 98%, or at least 99% identical to SEQ ID NO: 322.

In certain embodiments, the extracellular domain of the CAR comprises SEQ ID NO: 322. In certain embodiments, the extracellular domain of the CAR consists of SEQ ID NO: 322.

The CAR may be encoded by any one of the amino acid sequences provided in Table 17. The CAR may be encoded by an amino acid sequence selected from any one of SEQ ID NOS: 389-397. The CAR may be encoded by an amino acid sequence that is at least 85%, 90%, 95%, 96%, 97%, 98%, or at least 99% identical to any one of the amino acid sequences provided in Table 17. The CAR may be encoded by an amino acid sequence that is at least 85%, 90%, 95%, 96%, 97%, 98%, or at least 99% identical to any one of SEQ ID NOS: 389-397.

In particular embodiments, the CAR may be encoded by the amino acid sequence SEQ ID NO: 411. In particular embodiments, the CAR may be encoded by the polynucleotide sequence SEQ ID NO: 412.

TABLE 14

Humanized sCAR scFV candidates (LH) I

| Sequence | Seq id no | Name |
| --- | --- | --- |
| DAVVTQESALTSSPGETVTLTCRSSTGAVTTSNYASWVQEKPDHLFTG LIGGTNNRAPGVPARFSGSLIGDKAALTITGAQTEDEAIYFCVLWYSD HWVFGGGTKLTVLGGGGSGGGGSGGGGSGGGGSDVQLQESGPGLVAP SQSLSITCTVSGFLLTDYGVNWVRQSPGKGLEWLGVIWGDGITDYNSA LKSRLSVTKDNSKSQVFLKMNSLQSGDSARYYCVTGLFDYWGQGTTLT VSS | 290. | >52SR4_LH |
| QAVVTQEPSLTVSPGGTVTLTCRSSTGAVTTSNYASWFQQKPGQAPRT LIYGTNNRAPWTPARFSGSLLGGKAALTLSGAQPEDEAEYYCVLWYSD HWVFGGGTKLTVLGGGGSGGGGSGGGGSGGGGSQVQLQESGPGLVKP SETLSLTCTVSGFLLTDYGVNWIRQPPGKGLEWIGVIWGDGITDYNPS LKSRVTISVDTSKNQFSLKLSSVTAADTAVYYCARGLFDYWGQGTLVT VSS | 291. | >L1, H1 |
| QAVVTQEPSLTVSPGGTVTLTCGSSTGAVTTSNYASWVQQKPGQAPRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP SETLSLTCTVSGFLLTDYGVNWIRQPPGKGLEWIGVIWGDGITDYNPS LKSRVTISKDTSKNQFSLKLSSVTAADTAVYYCVTGLFDYWGQGTLVT VSS | 292. | >L2, H2 |
| QAVVTQEPSLTVSPGGTVTLTCGSSTGAVTTSNYASWVQQKPGQAPRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP SETLSLTCTVSGFLLTDYGVNWIRQPPGKGLEWIGVIWGDGITDYNPS LKSRVTISKDNSKNQFSLKLSSVTAADTAVYYCVTGLFDYWGQGTLVT VSS | 293. | >L2, H2b |
| QAVVTQEPSLTVSPGGTVTLTCGSSTGAVTTSNYASWVQQKPGQAPRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTAADTAVYYCVTGLFDYWGQGTLLT VSS | 294. | >L2, H3 |
| QAVVTQEPSLTVSPGGTVTLTCGSSTGAVTTSNYASWVQQKPGQAPRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDNSKNQVSLKMSSLTAADTAVYYCVTGLFDYWGQGTLLT VSS | 295. | >L2, H3b |
| QAVVTQEPSLTVSPGGTVTLTCGSSTGAVTTSNYASWVQQKPGQAPRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTAADTARYYCVTGLFDYWGQGTTLT VSS | 296. | >L2, H4 |
| QAVVTQEPSLTVSPGGTVTLTCGSSTGAVTTSNYASWVQQKPGQAPRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP | 297. | >L2, H4(A87D) |

TABLE 14-continued

Humanized sCAR scFV candidates (LH) I

| Sequence | Seq id no | Name |
|---|---|---|
| SETLSITCTVSGFLLTDYGVNWVRQPPKGLEWLGVIWGDGITDYNPS LKSRLTVSKDTSKNQVSLKMSSLTDADTARYYCVTGLFDYWGQGTTLT VSS | | |
| QAVVTQEPSLTVSPGGTVTLTCGSSTGAVTTSNYASWVQQKPGQAPRG LIGGTNNRAPGVPARFSGSLLGGKAALTISGAQPEDEAEYYCVLWYSD HWVFGGGTKLTVLGGGGSGGGGSGGGGSGGGGSQVQLQQSGPGLVKP SETLSITCTVSGFLLTDYGVNWVRQPPKGLEWLGVIWGDGITDYNPS LKSRLTVSKDNSKNQVSLKMSSLTAADTAVYYCVTGLFDYWGQGTLLT VSS | 298. | >L2, H5 |
| QAVVTQEPSLTVSPGGTVTLTCGSSTGAVTTSNYASWVQQKPGQAPRG LIGGTNNRAPGVPARFSGSLLGGKAALTISGAQPEDEAEYYCVLWYSD HWVFGGGTKLTVLGGGGSGGGGSGGGGSGGGGSQVQLQQSGPGLVKP SETLSITCTVSGFSLTDYGVNWVRQPPKGLEWLGVIWGDGSTDYNPS LKSRLTVSKDNSKNQVSLKMSSLTAADTAVYYCVTGLFDYWGQGTLLT VSS | 299. | >L2, H6 |
| QAVVTQEPSLTVSPGGTVTLTCRSSTGAVTTSNYASWVQQKPGQAPRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP SETLSITCTVSGFLLTDYGVNWVRQPPKGLEWLGVIWGDGITDYNPS LKSRLTVSKDNSKNQVSLKMSSLTAADTAVYYCVTGLFDYWGQGTLLT VSS | 300. | >L2(G23R), H3b |
| QAVVTQEPSLTVSPGGTVTLTCRSSTGAVTTSNYASWVQQKPGQAPRG LIGGTNNRAPGVPARFSGSLLGGKAALTISGAQPEDEAEYYCVLWYSD HWVFGGGTKLTVLGGGGSGGGGSGGGGSGGGGSQVQLQQSGPGLVKP SETLSITCTVSGFLLTDYGVNWVRQPPKGLEWLGVIWGDGITDYNPS LKSRLTVSKDNSKNQVSLKMSSLTAADTAVYYCVTGLFDYWGQGTLLT VSS | 301. | >L2(G23R), H5 |
| QAVVTQEPSLTVSPGGTVTLTCRSSTGAVTTSNYASWVQQKPGQAPRG LIGGTNNRAPGVPARFSGSLLGGKAALTISGAQPEDEAEYYCVLWYSD HWVFGGGTKLTVLGGGGSGGGGSGGGGSGGGGSQVQLQQSGPGLVKP SETLSITCTVSGFSLTDYGVNWVRQPPKGLEWLGVIWGDGSTDYNPS LKSRLTVSKDNSKNQVSLKMSSLTAADTAVYYCVTGLFDYWGQGTLLT VSS | 302. | >L2(G23R), H6 |
| QAVVTQEPSLTVSPGGTVTLTCGSSTGAVTTSNYASWVQQKPGQAFRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP SETLSLTCTVSGFLLTDYGVNWIRQPPKGLEWIGVIWGDGITDYNPS LKSRVTISKDTSKNQFSLKLSSVTAADTAVYYCVTGLFDYWGQGTLVT VSS | 303. | >L3, H2 |
| QAVVTQEPSLTVSPGGTVTLTCGSSTGAVTTSNYASWVQQKPGQAFRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP SETLSITCTVSGFLLTDYGVNWVRQPPKGLEWLGVIWGDGITDYNPS LKSRLTVSKDTSKNQVSLKMSSLTAADTAVYYCVTGLFDYWGQGTLLT VSS | 304. | >L3, H3 |
| QAVVTQEPSLTVSPGGTVTLTCGSSTGAVTTSNYASWVQQKPGQAFRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP SETLSITCTVSGFLLTDYGVNWVRQPPKGLEWLGVIWGDGITDYNPS LKSRLTVSKDTSKNQVSLKMSSLTDADTARYYCVTGLFDYWGQGTTLT VSS | 305. | >L3, H4(A87D) |
| QAVVTQEPSLTVSPGGTVTLTCGSSTGAVTTSNYASWVQQKPDHLFRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP SETLSLTCTVSGFLLTDYGVNWIRQPPKGLEWIGVIWGDGITDYNPS LKSRVTISKDTSKNQFSLKLSSVTAADTAVYYCVTGLFDYWGQGTLVT VSS | 306. | >L4, H2 |
| QAVVTQEPSLTVSPGGTVTLTCGSSTGAVTTSNYASWVQQKPDHLFRG LIGGTNNRAPGVPARFSGSLLGGKAALTISGAQPEDEAEYYCVLWYSD HWVFGGGTKLTVLGGGGSGGGGSGGGGSGGGGSQVQLQESGPGLVKP SETLSITCTVSGFLLTDYGVNWVRQPPKGLEWLGVIWGDGITDYNPS LKSRLTVSKDTSKNQVSLKMSSLTAADTAVYYCVTGLFDYWGQGTLLT VSS | 307. | >L4, H3 |

TABLE 14-continued

Humanized sCAR scFV candidates (LH) I

| Sequence | Seq id no | Name |
|---|---|---|
| QAVVTQEPSLTVSPGGTVTLTCGSSTGAVTTSNYASWVQQKPDHLFRG<br>LIGGTNNRAPGVPARFSGSLLGGKAALTISGAQPEDEAEYYCVLWYSD<br>HWVFGGGTKLTVLGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTAADTARYYCVTGLFDYWGQGTTLT<br>VSS | 308. | >L4, H4 |
| QAVVTQEPSLTVSPGGTVTLTCGSSTGAVTTSNYASWVQQKPDHLFRG<br>LIGGTNNRAPGVPARFSGSLLGGKAALTISGAQPEDEAEYYCVLWYSD<br>HWVFGGGTKLTVLGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTDADTARYYCVTGLFDYWGQGTTLT<br>VSS | 309. | >L4, H4 (A87D) |
| QAVVTQEPSLTVSPGGTVTLTCGSSTGAVTTSNYASWVQQKPDHLFRG<br>LIGGTNNRAPGVPARFSGSLIGDKAALTISGAQPEDEAEYYCVLWYSD<br>HWVFGGGTKLTVLGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTAADTARYYCVTGLFDYWGQGTTLT<br>VSS | 310. | >L4(L67I, G69D),<br>H4 |
| QAVVTQEPSLTVSPGGTVTLTCRSSTGAVTTSNYASWVQQKPDHLFRG<br>LIGGTNNRAPGVPARFSGSLIGDKAALTISGAQPEDEAEYYCVLWYSD<br>HWVFGGGTKLTVLGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTAADTARYYCVTGLFDYWGQGTTLT<br>VSS | 311. | >L4(G23R, L67I,<br>G69D),<br>H4 |
| QAVVTQEPSLTVSPGGTVTLTCRSSTGAVTTSNYASWVQQKPDHLFRG<br>LIGGTNNRAPGVPARFSGSLLGGKAALTISGAQPEDEAEYYCVLWYSD<br>HWVFGGGTKLTVLGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTAADTARYYCVTGLFDYWGQGTTLT<br>VSS | 312. | >L4(G23R),<br>H4 |
| QAVVTQEPSLTVSPGGTVTLTCRSSTGAVTTSNYASWVQQKPDHLFRG<br>LIGGTNNRAPGVPARFSGSLLGGKAALTISGAQPEDEAEYYCVLWYSD<br>HWVFGGGTKLTVLGGGGSGGGGSGGGGSGGGGSQVQLQQSGPGLVKP<br>SETLSITCTVSGFLLTDYGVNWVRQPPGKGLEWLGVIWGDGITDYNPS<br>LKSRLTVSKDTSKNQVSLKMSSLTAADTARYYCVTGLFDYWGQGTTLT<br>VSS | 313. | >L4(G23R),<br>H4(E6Q) |
| QAVVTQEPSLTVSPGGTVTLTCGSSTGAVTTSNYASWVQEKPDHLFRG<br>LIGGTNNRAPGVPARFSGSLLGGKAALTISGAQPEDEAIYFCVLWYSD<br>HWVFGGGTKLTVLGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTAADTARYYCVTGLFDYWGQGTTLT<br>VSS | 314. | >L5, H4 |
| QAVVTQEPSLTVSPGGTVTLTCGSSTGAVTTSNYASWVQEKPDHLFRG<br>LIGGTNNRAPGVPARFSGSLLGGKAALTISGAQPEDEAIYFCVLWYSD<br>HWVFGGGTKLTVLGGGGSGGGGSGGGGSGGGGSQVQLQQSGPGLVKP<br>SETLSITCTVSGFLLTDYGVNWVRQPPGKGLEWLGVIWGDGITDYNPS<br>LKSRLTVSKDTSKNQVSLKMSSLTAADTARYYCVTGLFDYWGQGTTLT<br>VSS | 315. | >L5, H4(E6Q) |
| QAVVTQEPSLTVSPGGTVTLTCGSSTGAVTTSNYASWVQEKPDHLFRG<br>LIGGTNNRAPGVPARFSGSLLGGKAALTISGAQPEDEAIYFCVLWYSD<br>HWVFGGGTKLTVLGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTDADTARYYCVTGLFDYWGQGTTLT<br>VSS | 316. | >L5, H4(A87D) |
| QAVVTQEPSLTVSPGGTVTLTCGSSTGAVTTSNYASWVQEKPDHLFRG<br>LIGGTNNRAPGVPARFSGSLLGGKAALTISGAQPEDEAIYFCVLWYSD<br>HWVFGGGTKLTVLGGGGSGGGGSGGGGSGGGGSQVQLQQSGPGLVKP<br>SETLSITCTVSGFLLTDYGVNWVRQPPGKGLEWLGVIWGDGITDYNPS<br>LKSRLTVSKDTSKNQVSLKMSSLTDADTARYYCVTGLFDYWGQGTTLT<br>VSS | 317. | >L5, H4(E6Q,<br>A87D) |

TABLE 14-continued

Humanized sCAR scFV candidates (LH) I

| Sequence | Seq id no | Name |
|---|---|---|
| QAVVTQEPSLTSSPGGTVTLTCGSSTGAVTTSNYASWVQEKPDHLFRG<br>LIGGTNNRAPGVPARFSGSLLGGKAALTISGAQPEDEAIYFCVLWYSD<br>HWVFGGGTKLTVLGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTAADTARYYCVTGLFDYWGQGTTLT<br>VSS | 318. | >L5(V12S),<br>H4 |
| QAVVTQEPSLTSSPGGTVTLTCGSSTGAVTTSNYASWVQEKPDHLFRG<br>LIGGTNNRAPGVPARFSGSLLGGKAALTISGAQPEDEAIYFCVLWYSD<br>HWVFGGGTKLTVLGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTDADTARYYCVTGLFDYWGQGTTLT<br>VSS | 319. | >L5(V12S),<br>H4(A87D) |
| QAVVTQEPSLTVSPGGTVTLTCGSSTGAVTTSNYASWVQEKPDHLFRG<br>LIGGTNNRAPGVPARFSGSLLGGKAALTISGAQPEDEAIYFCVLWYSD<br>HWVFGGGTKLTVDGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTAADTARYYCVTGLFDYWGQGTTLT<br>VSS | 320. | >L5(L109D),<br>H4 |
| QAVVTQEPSLTVSPGGTVTLTCGSSTGAVTTSNYASWVQEKPDHLFRG<br>LIGGTNNRAPGVPARFSGSLLGGKAALTISGAQPEDEAIYFCVLWYSD<br>HWVFGGGTKLTVDGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTDADTARYYCVTGLFDYWGQGTTLT<br>VSS | 321. | >L5(L109D),<br>H4(A87D) |
| QAVVTQEPSLTVSPGGTVTLTCGSSTGAVTTSNYASWVQEKPDHLFRG<br>LIGGTNNRAPGVPARFSGSLLGGKAALTISGAQPEDEAIYFCVLWYSD<br>HWVFGGGTKLTVDGGGGSGGGGSGGGGSGGGGSQVQLQQSGPGLVKP<br>SETLSITCTVSGFLLTDYGVNWVRQPPGKGLEWLGVIWGDGITDYNPS<br>LKSRLTVSKDTSKNQVSLKMSSLTDADTARYYCVTGLFDYWGQGTTLT<br>VSS | 322. | >L5(L109D),<br>H4(E6Q, A87D) |
| QAVVTQEPSLTSSPGGTVTLTCGSSTGAVTTSNYASWVQEKPDHLFRG<br>LIGGTNNRAPGVPARFSGSLLGGKAALTISGAQPEDEAIYFCVLWYSD<br>HWVFGGGTKLTVDGGGGSGGGGSGGGGSGGGGSQVQLQESGPGLVKP<br>SETLSITCTVSGFLLTDYGVNWVRQPPGKGLEWLGVIWGDGITDYNPS<br>LKSRLTVSKDTSKNQVSLKMSSLTDADTARYYCVTGLFDYWGQGTTLT<br>VSS | 323. | >L5(V12S, L109D),<br>H4(A87D) |
| QAVVTQEPSLTSSPGGTVTLTCGSSTGAVTTSNYASWVQEKPDHLFRG<br>LIGGTNNRAPGVPARFSGSLLGGKAALTISGAQPEDEAIYFCVLWYSD<br>HWVFGGGTKLTVDGGGGSGGGGSGGGGSGGGGSQVQLQQSGPGLVKP<br>SETLSITCTVSGFLLTDYGVNWVRQPPGKGLEWLGVIWGDGITDYNPS<br>LKSRLTVSKDTSKNQVSLKMSSLTDADTARYYCVTGLFDYWGQGTTLT<br>VSS | 324. | >L5(V12S, L109D),<br>H4(E6Q,<br>A87D) |
| QAVVTQEPSLTSSPGGTVTLTCGSSTGAVTTSNYASWVQQKPDHLFRG<br>LIGGTNNRAPGVPARFSGSLLGGKAALTISGAQPEDEAIYFCVLWYSD<br>HWVFGGGTKLTVDGGGGSGGGGSGGGGSGGGGSQVQLQQSGPGLVKP<br>SETLSITCTVSGFLLTDYGVNWVRQPPGKGLEWLGVIWGDGITDYNPS<br>LKSRLTVSKDTSKNQVSLKMSSLTDADTARYYCVTGLFDYWGQGTTLT<br>VSS | 325. | >L5(V12S, E40Q,<br>L109D),<br>H4(E6Q, A87D) |
| QAVVTQEPSLTSSPGGTVTLTCGSSTGAVTTSNYASWVQEKPDHLFRG<br>LIGGTNNRAPGVPARFSGSLLGGKAALTISGAQPEDEAEYFCVLWYSD<br>HWVFGGGTKLTVDGGGGSGGGGSGGGGSGGGGSQVQLQQSGPGLVKP<br>SETLSITCTVSGFLLTDYGVNWVRQPPGKGLEWLGVIWGDGITDYNPS<br>LKSRLTVSKDTSKNQVSLKMSSLTDADTARYYCVTGLFDYWGQGTTLT<br>VSS | 326. | >L5(V12S, I87E,<br>L109D),<br>H4(E6Q, A87D) |
| QAVVTQEPSLTSSPGGTVTLTCGSSTGAVTTSNYASWVQEKPDHLFRG<br>LIGGTNNRAPGVPARFSGSLLGGKAALTISGAQPEDEAIYYCVLWYSD<br>HWVFGGGTKLTVDGGGGSGGGGSGGGGSGGGGSQVQLQQSGPGLVKP<br>SETLSITCTVSGFLLTDYGVNWVRQPPGKGLEWLGVIWGDGITDYNPS<br>LKSRLTVSKDTSKNQVSLKMSSLTDADTARYYCVTGLFDYWGQGTTLT<br>VSS | 327. | >L5(V12S, F89Y,<br>L109D),<br>H4(E6Q, A87D) |

TABLE 14-continued

Humanized sCAR scFV candidates (LH) I

| Sequence | Seq id no | Name |
|---|---|---|
| QAVVTQEPSLTSSPGGTVTLTCGSSTGAVTTSNYASWVQQKPDHLFRG LIGGTNNRAPGVPARFSGSLLGGKAALTISGAQPEDEAEYFCVLWYSD HWVFGGGTKLTVDGGGGSGGGGSGGGGSGGGGSQVQLQQSGPGLVKP SETLSITCTVSGFLLTDYGVNWVRQPPGKGLEWLGVIWGDGITDYNPS LKSRLTVSKDTSKNQVSLKMSSLTDADTARYYCVTGLFDYWGQGTTLT VSS | 328. | >L5(V12S, E40Q, I87E, L109D), H4(E6Q, A87D) |
| QAVVTQEPSLTSSPGGTVTLTCGSSTGAVTTSNYASWVQQKPDHLFRG LIGGTNNRAPGVPARFSGSLLGGKAALTISGAQPEDEAIYYCVLWYSD HWVFGGGTKLTVDGGGGSGGGGSGGGGSGGGGSQVQLQQSGPGLVKP SETLSITCTVSGFLLTDYGVNWVRQPPGKGLEWLGVIWGDGITDYNPS LKSRLTVSKDTSKNQVSLKMSSLTDADTARYYCVTGLFDYWGQGTTLT VSS | 329. | >L5(V12S, E40Q, F89Y, L109D), H4(E6Q, A87D) |
| QAVVTQEPSLTSSPGGTVTLTCGSSTGAVTTSNYASWVQEKPDHLFRG LIGGTNNRAPGVPARFSGSLLGGKAALTISGAQPEDEAEYYCVLWYSD HWVFGGGTKLTVDGGGGSGGGGSGGGGSGGGGSQVQLQQSGPGLVKP SETLSITCTVSGFLLTDYGVNWVRQPPGKGLEWLGVIWGDGITDYNPS LKSRLTVSKDTSKNQVSLKMSSLTDADTARYYCVTGLFDYWGQGTTLT VSS | 330. | >L5(V12S, I87E, F89Y, L109D), H4(E6Q, A87D) |
| QAVVTQEPSLTSSPGGTVTLTCGSSTGAVTTSNYASWVQQKPDHLFRG LIGGTNNRAPGVPARFSGSLLGGKAALTISGAQPEDEAEYYCVLWYSD HWVFGGGTKLTVDGGGGSGGGGSGGGGSGGGGSQVQLQQSGPGLVKP SETLSITCTVSGFLLTDYGVNWVRQPPGKGLEWLGVIWGDGITDYNPS LKSRLTVSKDTSKNQVSLKMSSLTDADTARYYCVTGLFDYWGQGTTLT VSS | 331. | >L5(V12S, E40Q, I87E, F89Y, L109D), H4(E6Q, A87D) |
| QAVVTQEPSLTSVPGGTVTLTCGSSTGAVTTSNYASWVQEKPDHLFRG LIGGTNNRAPGVPARFSGSLLGGKAALTISGAQPEDEAIYFCVLWYSD HWVFGGGTKLTVDGGGGSGGGGSGGGGSGGGGSDVQLQESGPGLVAP SQSLSITCTVSGFLLTDYGVNWVRQSPGKGLEWLGVIWGDGITDYNSA LKSRLSVTKDNSKSQVFLKMNSLQSGDSARYYCVTGLFDYWGQGTTLT VSS | 332. | >L5(L109D), muH_52SR4 |
| QAVVTQEPSLTSSPGGTVTLTCGSSTGAVTTSNYASWVQEKPDHLFRG LIGGTNNRAPGVPARFSGSLLGGKAALTISGAQPEDEAIYFCVLWYSD HWVFGGGTKLTVDGGGGSGGGGSGGGGSGGGGSDVQLQESGPGLVAP SQSLSITCTVSGFLLTDYGVNWVRQSPGKGLEWLGVIWGDGITDYNSA LKSRLSVTKDNSKSQVFLKMNSLQSGDSARYYCVTGLFDYWGQGTTLT VSS | 333. | >L5(V12S, L109D), muH_52SR4 |
| QAVVTQEPSLTSSPGGTVTLTCGSSTGAVTTSNYASWVQEKPDHLFRG LIGGTNNRAPGVPARFSGSLDGGKAALTISGAQPEDEAIYFCVLWYSD HWVFGGGTKLTVSGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTDADTARYYCVTGLFDYWGQGTTLT VSS | 334. | >L5(V12S, L69D, L109S), H4(A87D) |
| QAVVTQEPSLTSSPGGTVTLTCRSSTGAVTTSNYASWVQEKPDHLFRG LIGGTNNRAPGVPARFSGSLLGGKAALTISGAQPEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTAADTARYYCVTGLFDYWGQGTTLT VSS | 335. | >L5(V12S, G23R), H4 |
| QAVVTQEPSLTSSPGGTVTLTCRSSTGAVTTSNYASWVQEKPDHLFRG LIGGTNNRAPGVPARFSGSLLGGKAALTISGAQPEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTDADTARYYCVTGLFDYWGQGTTLT VSS | 336. | >L5(V12S, G23R), H4(A87D) |
| QAVVTQEPSLTSSPGGTVTLTCGSSTGAVTTSNYASWVQEKPDHLFRG LIGGTNNRAPGVPARFSGSLDGGKAALTISGAQPEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTDADTARYYCVTGLFDYWGQGTTLT VSS | 337. | >L5(V12S, L69D), H4(A87D) |

TABLE 14-continued

Humanized sCAR scFV candidates (LH) I

| Sequence | Seq id no | Name |
|---|---|---|
| QAVVTQEPSLTVSPGGTVTLTCGSSTGAVTTSNYASWVQEKPDHLFRG LIGGTNNRAPGVPARFSGSLLGGKAALTISGAQPEDEAIYFCVLWYSD HWVFGGGTKLTVGGGGSGGGGSGGGGSGGGGSQVQLQESGPGLVKPS ETLSITCTVSGFLLTDYGVNWVRQPPGKGLEWLGVIWGDGITDYNPSL KSRLTVSKDTSKNQVSLKMSSLTAADTARYYCVTGLFDYWGQGTTLTV SS | 338. | >L5(ΔL109), H4 |
| QAVVTQEPSLTVSPGGTVTLTCGSSTGAVTTSNYASWVQEKPDHLFRG LIGGTNNRAPGVPARFSGSLLGGKAALTISGAQPEDEAIYFCVLWYSD HWVFGGGTKLTVGGGGSGGGGSGGGGSGGGGSQVQLQESGPGLVKPS ETLSITCTVSGFLLTDYGVNWVRQPPGKGLEWLGVIWGDGITDYNPSL KSRLTVSKDTSKNQVSLKMSSLTDADTARYYCVTGLFDYWGQGTTLTV SS | 339. | >L5(ΔL109), H4(A87D) |
| QAVVTQEPSLTSSPGGTVTLTCGSSTGAVTTSNYASWVQEKPDHLFRG LIGGTNNRAPGVPARFSGSLDGGKAALTISGAQPEDEAIYFCVLWYSD HWVFGGGTKLTVSGGGGSGGGGSGGGGSGGGGSDVQLQESGPGLVAP SQSLSITCTVSGFLLTDYGVNWVRQSPGKGLEWLGVIWGDGITDYNSA LKSRLSVTKDNSKSQVFLKMNSLQSGDSARYYCVTGLFDYWGQGTTLT VSS | 340. | >L5(V12S, L69D, L109S), muH_52SR4 |
| QAVVTQEPSLTSSPGGTVTLTCGSSTGAVTTSNYASWVQEKPDHLFRG LIGGTNNRAPGVPARFSGSLLGGKAALTISGAQPEDEAIYFCVLWYSD HWVFGGGTKLTVLGGGGSGGGGSGGGGSGGGGSDVQLQESGPGLVAP SQSLSITCTVSGFLLTDYGVNWVRQSPGKGLEWLGVIWGDGITDYNSA LKSRLSVTKDNSKSQVFLKMNSLQSGDSARYYCVTGLFDYWGQGTTLT VSS | 341. | >L5(V12S), muH_52SR4 |
| QAVVTQEPSLTSSPGGTVTLTCGSSTGAVTTSNYASWVQEKPDHLFRG LIGGTNNRAPGVPARFSGSLLGGKAALTISGAQPEDEAIYFCVLWYSD HWVFGGGTKLTVLGGGGSGGGGSGGGGSGGGGSQVQLQQSGPGLVKP SETLSITCTVSGFLLTDYGVNWVRQPPGKGLEWLGVIWGDGITDYNPS LKSRLTVSKDTSKNQVSLKMSSLTAADTARYYCVTGLFDYWGQGTTLT VSS | 342. | >L5(V12S), H4(E6Q) |
| QAVVTQEPSLTSSPGGTVTLTCGSSTGAVTTSNYASWVQEKPDHLFRG LIGGTNNRAPGVPARFSGSLDGGKAALTISGAQPEDEAIYFCVLWYSD HWVFGGGTKLTVSGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTSADTARYYCVTGLFDYWGQGTTLT VSS | 343. | >L5(V12S, L69D, L109S), H4(A87S) |
| QAVVTQEPSLTSSPGGTVTLTCGSSTGAVTTSNYASWVQEKPDHLFRG LIGGTNNRAPGVPARFSGSLLGGKAALTISGAQPEDEAIYFCVLWYSD HWVFGGGTKLTVSGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTAADTARYYCVTGLFDYWGQGTTLT VSS | 344. | >L5(V12S, L109S), H4 |
| QAVVTQEPSLTSSPGGTVTLTCGSSTGAVTTSNYASWVQEKPDHLFRG LIGGTNNRAPGVPARFSGSLLGGKAALTISGAQPEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTAADTARYYCVTGLFDYWGQGTTLT VSS | 345. | >L5(V12S, L69D), H4 |
| QAVVTQEPSLTSSPGGTVTLTCGSSTGAVTTSNYASWVQEKPDHLFRG LIGGTNNRAPGVPARFSGSLLGGKAALTISGAQPEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTSADTARYYCVTGLFDYWGQGTTLT VSS | 346. | >L5(V12S), H4(A87S) |
| QAVVTQEPSLTVSPGGTVTLTCRSSTGAVTTSNYASWVQEKPDHLFRG LIGGTNNRAPGVPARFSGSLLGGKAALTISGAQPEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTAADTARYYCVTGLFDYWGQGTTLT VSS | 347. | >L5(G23R), H4 |

TABLE 14-continued

| Humanized sCAR scFV candidates (LH) I | | |
|---|---|---|
| Sequence | Seq id no | Name |
| QAVVTQEPSLTVSPGGTVTLTCGSSTGAVTTSNYASWVQEKPDHLFRG LIGGTNNRAPGVPARFSGSLLGGKAALTISGAQPEDEAIYFCVLWYSD HWVFGGGTKLTVLGGGGSGGGGSGGGGSGGGGSQVQLQQSGPGLVKP SETLSITCTVSGFSLTDYGVNWVRQPPGKGLEWLGVIWGDGSTDYNPS LKSRLTVSKDNSKNQVSLKMSSLTAADTAVYYCVTGLFDYWGQGTLLT VSS | 348. | >L5, H6 |
| QAVVTQEPSLTVSPGGTVTLTCGSSTGAVTTSNYASWVQEKPDHLFRG LIGGTNNRAPGVPARFSGSLLGGKAALTISGAQPEDEAIYFCVLWYSD HWVFGGGTKLTVLGGGGSGGGGSGGGGSGGGGSQVQLQQSGPGLVKP SETLSITCTVSGFSLTDYGVNWVRQPPGKGLEWLGVIWGDGSTDYNPS LKSRLTVSKDTSKNQVSLKMSSLTAADTAVYYCVTGLFDYWGQGTLLT VSS | 349. | >L5, H6(N73T) |
| QAVVTQEPSLTVSPGGTVTLTCGSSTGAVTTSNYASWVQEKPGQAFRG LIGGTNNRAPGVPARFSGSLLGGKAALTISGAQPEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTAADTARYYCVTGLFDYWGQGTTLT VSS | 350. | >L6(P46F), H4 |
| QAVVTQEPSLTVSPGGTVTLTCGSSTGAVTTSNYASWVQEKPGQAFRG LIGGTNNRAPGVPARFSGSLLGGKAALTISGAQPEDEAIYFCVLWYSD HWVFGGGTKLTVLGGGGSGGGGSGGGGSGGGGSQVQLQQSGPGLVKP SETLSITCTVSGFLLTDYGVNWVRQPPGKGLEWLGVIWGDGITDYNPS LKSRLTVSKDTSKNQVSLKMSSLTAADTARYYCVTGLFDYWGQGTTLT VSS | 351. | >L6(P46F), H4(E6Q) |
| QAVVTQEPSLTVSPGGTVTLTCGSSTGAVTTSNYASWVQEKPGQAPRG LIGGTNNRAPGVPARFSGSLLGGKAALTISGAQPEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTDADTARYYCVTGLFDYWGQGTTLT VSS | 352. | >L6, H4(A87D) |
| QAVVTQEPSLTVSPGGTVTLTCGSSTGAVTTSNYASWVQEKPGQAFRG LIGGTNNRAPGVPARFSGSLLGGKAALTISGAQPEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTDADTARYYCVTGLFDYWGQGTTLT VSS | 353. | >L6(P46F), H4(A87D) |
| QAVVTQEPSLTVSPGGTVTLTCGSSTGAVTTSNYASWVQEKPGQAPRG LIGGTNNRAPGVPARFSGSLLGGKAALTISGAQPEDEAIYFCVLWYSD HWVFGGGTKLTVLGGGGSGGGGSGGGGSGGGGSQVQLQQSGPGLVKP SETLSITCTVSGFSLTDYGVNWVRQPPGKGLEWLGVIWGDGSTDYNPS LKSRLTVSKDNSKNQVSLKMSSLTAADTAVYYCVTGLFDYWGQGTLLT VSS | 354. | >L6, H6 |
| DAVVTQESALTTSPGETVTLTCRSSTGAVTTSNYANWVQEKPDHLFTG LIGGTNNRAPGVPARFSGSLIGDKAALTITGAQTEDEAIYFCALWYSN HWVFGGGTKLTVLGGGGSGGGGSGGGGSGGGGSDVQLQESGPGLVAP SQSLSITCTVSGFSLTDYGVNWVRQSPGKGLEWLGVIWGDGITDYNSA LKSRLSVTKDNSKSQVPLKMNSLQSGDSARYYCVTGLFDYWGQGTTLT VSS | 355. | >c11 |
| DAVVTQESALTSSPGETVTLTCRSSTGAVTTSNYASWVQEKPDHLFTG LIGGTNNRAPGVPARFSGSLIGDKAALTITGAQTEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTDADTARYYCVTGLFDYWGQGTTLT VSS | 356. | >muL_52SR4, H4(A87D) |
| DAVVTQESALTSSPGETVTLTCRSSTGAVTTSNYASWVQEKPDHLFTG LIGGTNNRAPGVPARFSGSLIGDKAALTITGAQTEDEAIYFCVLWYSD HWVFGGGTKLTVLGGGGSGGGGSGGGGSGGGGSQVQLQQSGPGLVKP SETLSITCTVSGFLLTDYGVNWVRQPPGKGLEWLGVIWGDGITDYNPS LKSRLTVSKDTSKNQVSLKMSSLTDADTARYYCVTGLFDYWGQGTTLT VSS | 357. | >muL_52SR4, H4(E6Q, A87D) |

TABLE 14-continued

Humanized sCAR scFV candidates (LH) I

| Sequence | Seq id no | Name |
|---|---|---|
| DAVVTQESALTSSPGETVTLTCRSSTGAVTTSNYASWVQEKPDHLFTG LIGGTNNRAPGVPARFSGSLIGDKAALTITGAQTEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTSADTARYYCVTGLFDYWGQGTTLT VSS | 358. | >muL_52SR4, H4(A87S) |
| DAVVTQESALTSSPGETVTLTCRSSTGAVTTSNYASWVQEKPDHLFTG LIGGTNNRAPGVPARFSGSLIGDKAALTITGAQTEDEAIYFCVLWYSD HWVFGGGTKLTVLGGGGSGGGGSGGGGSGGGGSQVQLQESGPGLVKP SETLSITCTVSGFLLTDYGVNWVRQPPGKGLEWLGVIWGDGITDYNPS LKSRLTVSKDTSKNQVSLKMSSLTAADTARYYCVTGLFDYWGQGTTLT VSS | 359. | >muL_52SR4, H4 |

TABLE 15

Humanized sCAR scFV candidates (HL) II

| Sequence | Seq id no | Name |
|---|---|---|
| QVQLQESGPGLVKPSETLSITCTVSGFLLTDYGVNWVRQPPGKGLEWL GVIWGDGITDYNPSLKSRLTVSKDTSKNQVSLKMSSLTAADTARYYCV TGLFDYWGQGTTLTVSSGGGGSGGGGSGGGGSGGGGSQAVVTQEPSLT VSPGGTVTLTCGSSTGAVTTSNYASWVQEKPDHLFRGLIGGTNNRAPG VPARFSGSLLGGKAALTISGAQPEDEAIYFCVLWYSDHWVFGGGTKLT VLG | 360. | >H4, L5 |
| QVQLQESGPGLVKPSETLSITCTVSGFLLTDYGVNWVRQPPGKGLEWL GVIWGDGITDYNPSLKSRLTVSKDTSKNQVSLKMSSLTAADTARYYCV TGLFDYWGQGTTLTVSSGGGGSGGGGSGGGGSGGGGSQAVVTQEPSLT SSPGGTVTLTCGSSTGAVTTSNYASWVQEKPDHLFRGLIGGTNNRAPG VPARFSGSLLGGKAALTISGAQPEDEAIYFCVLWYSDHWVFGGGTKLT VLG | 423. | >H4, L5(V12S) |
| QVQLQQSGPGLVKPSETLSITCTVSGFLLTDYGVNWVRQPPGKGLEWL GVIWGDGITDYNPSLKSRLTVSKDTSKNQVSLKMSSLTSADTARYYCV TGLFDYWGQGTTLTVSSGGGGSGGGGSGGGGSGGGGSQAVVTQEPSLT VSPGGTVTLTCGSSTGAVTTSNYASWVQEKPDHLFRGLIGGTNNRAPG VPARFSGSLLGGKAALTISGAQPEDEAIYFCVLWYSDHWVFGGGTKLT VLG | 361. | >H4(E6Q, A87S), L5 |
| QVQLQQSGPGLVKPSETLSITCTVSGFLLTDYGVNWVRQPPGKGLEWL GVIWGDGITDYNPSLKSRLTVSKDTSKNQVSLKMSSLTSADTARYYCV TGLFDYWGQGTTLTVSSGGGGSGGGGSGGGGSGGGGSQAVVTQEPSLT VSPGGTVTLTCRSSTGAVTTSNYASWVQEKPDHLFRGLIGGTNNRAPG VPARFSGSLLGGKAALTISGAQPEDEAIYFCVLWYSDHWVFGGGTKLT VLG | 362. | >H4(E6Q, A87S), L5(G23R) |
| QVQLQQSGPGLVKPSETLSITCTVSGFSLTDYGVNWVRQPPGKGLEWL GVIWGDGSTDYNPSLKSRLTVSKDNSKNQVSLKMSSLTAADTAVYYCV TGLFDYWGQGTLLTVSSGGGGSGGGGSGGGGSGGGGSQAVVTQEPSLT VSPGGTVTLTCGSSTGAVTTSNYASWVQQKPGQAPRGLIGGTNNRAPG VPARFSGSLLGGKAALTISGAQPEDEAEYYCVLWYSDHWVFGGGTKLT VLG | 363. | >H6, L2 |
| QVQLQESGPGLVKPSETLSITCTVSGFLLTDYGVNWVRQPPGKGLEWL GVIWGDGITDYNPSLKSRLTVSKDNSKNQVSLKMSSLTAADTAVYYCV TGLFDYWGQGTLLTVSSGGGGSGGGGSGGGGSGGGGSQAVVTQEPSLT VSPGGTVTLTCGSSTGAVTTSNYASWVQQKPGQAPRGLIGGTNNRAPG VPARFSGSLLGGKAALTISGAQPEDEAEYYCVLWYSDHWVFGGGTKLT VLG | 364. | >H3b, L2 |
| QVQLQQSGPGLVKPSETLSITCTVSGFLLTDYGVNWVRQPPGKGLEWL GVIWGDGITDYNPSLKSRLTVSKDNSKNQVSLKMSSLTAADTAVYYCV TGLFDYWGQGTLLTVSSGGGGSGGGGSGGGGSGGGGSQAVVTQEPSLT VSPGGTVTLTCGSSTGAVTTSNYASWVQQKPGQAPRGLIGGTNNRAPG VPARFSGSLLGGKAALTISGAQPEDEAEYYCVLWYSDHWVFGGGTKLT VLG | 365. | >H5, L2 |

TABLE 15-continued

Humanized sCAR scFV candidates (HL) II

| Sequence | Seq id no | Name |
|---|---|---|
| QVQLQESGPGLVKPSETLSITCTVSGFLLTDYGVNWVRQPPGKGLEWL GVIWGDGITDYNPSLKSRLTVSKDTSKNQVSLKMSSLTAADTARYYCV TGLFDYWGQGTTLTVSSGGGGSGGGGSGGGGSGGGGSQAVVTQEPSLT VSPGGTVTLTCRSSTGAVTTSNYASWVQEKPDHLFRGLIGGTNNRAPG VPARFSGSLLGGKAALTISGAQPEDEAIYFCVLWYSDHWVFGGGTKLT VLG | 366. | >H4, L5(G23R) |
| QVQLQQSGPGLVKPSETLSITCTVSGFSLTDYGVNWVRQPPGKGLEWL GVIWGDGSTDYNPSLKSRLTVSKDNSKNQVSLKMSSLTAADTAVYYCV TGLFDYWGQGTLLTVSSGGGGSGGGGSGGGGSGGGGSQAVVTQEPSLT VSPGGTVTLTCRSSTGAVTTSNYASWVQQKPGQAPRGLIGGTNNRAPG VPARFSGSLLGGKAALTISGAQPEDEAEYYCVLWYSDHWVFGGGTKLT VLG | 367. | >H6, L2(G23R) |
| QVQLQESGPGLVKPSETLSITCTVSGFLLTDYGVNWVRQPPGKGLEWL GVIWGDGITDYNPSLKSRLTVSKDNSKNQVSLKMSSLTAADTAVYYCV TGLFDYWGQGTLLTVSSGGGGSGGGGSGGGGSGGGGSQAVVTQEPSL TVSPGGTVTLTCRSSTGAVTTSNYASWVQQKPGQAPRGLIGGTNNRAP GVPARFSGSLLGGKAALTISGAQPEDEAEYYCVLWYSDHWVFGGGTKL TVL | 368. | >H3b, L2(G23R)* |
| QVQLQQSGPGLVKPSETLSITCTVSGFLLTDYGVNWVRQPPGKGLEWL GVIWGDGITDYNPSLKSRLTVSKDNSKNQVSLKMSSLTAADTAVYYCV TGLFDYWGQGTLLTVSSGGGGSGGGGSGGGGSGGGGSQAVVTQEPSL TVSPGGTVTLTCRSSTGAVTTSNYASWVQQKPGQAPRGLIGGTNNRAP GVPARFSGSLLGGKAALTISGAQPEDEAEYYCVLWYSDHWVFGGGTKL TVL | 369. | >H5, L2(G23R)* |
| QVQLQESGPGLVKPSETLSITCTVSGFLLTDYGVNWVRQPPGKGLEWL GVIWGDGITDYNPSLKSRLTVSKDTSKNQVSLKMSSLTSADTARYYCV TGLFDYWGQGTTLTVSSGGGGSGGGGSGGGGSGGGGSQAVVTQEPSLT SSPGGTVTLTCGSSTGAVTTSNYASWVQEKPDHLFRGLIGGTNNRAPG VPARFSGSLDGGKAALTISGAQPEDEAIYFCVLWYSDHWVFGGGTKLT VSG | 370. | >H4(A87S), L5(V12S, L69D, L109S) |
| QVQLQQSGPGLVKPSETLSITCTVSGFLLTDYGVNWVRQPPGKGLEWL GVIWGDGITDYNPSLKSRLTVSKDTSKNQVSLKMSSLTAADTARYYCV TGLFDYWGQGTTLTVSSGGGGSGGGGSGGGGSGGGGSQAVVTQEPSLT VSPGGTVTLTCGSSTGAVTTSNYASWVQEKPDHLFRGLIGGTNNRAPG VPARFSGSLLGGKAALTISGAQPEDEAIYFCVLWYSDHWVFGGGTKLT VLG | 371. | >H4(E6Q), L5 |
| QVQLQQSGPGLVKPSETLSITCTVSGFLLTDYGVNWVRQPPGKGLEWL GVIWGDGITDYNPSLKSRLTVSKDTSKNQVSLKMSSLTAADTARYYCV TGLFDYWGQGTTLTVSSGGGGSGGGGSGGGGSGGGGSQAVVTQEPSLT VSPGGTVTLTCGSSTGAVTTSNYASWVQEKPDHLFRGLIGGTNNRAPG VPARFSGSLLGGKAALTISGAQPEDEAIYFCVLWYSDHWVFGGGTKLT VDG | 372. | >H4(E6Q), L5 (L109D) |
| DVQLQESGPGLVAPSQSLSITCTVSGFLLTDYGVNWVRQSPGKGLEWL GVIWGDGITDYNSALKSRLSVTKDNSKSQVFLKMNSLQSGDSARYYCV TGLFDYWGQGTTLTVSSGGGGSGGGGSGGGGSGGGGSDAVVTQESALT SSPGETVTLTCRSSTGAVTTSNYASWVQEKPDHLFTGLIGGTNNRAPG VPARFSGSLIGDKAALTITGAQTEDEAIYFCVLWYSDHWVFGGGTKLT VLG | 373. | >52SR4_HL |
| QVQLQQSGPGLVKPSETLSITCTVSGFLLTDYGVNWVRQPPGKGLEWL GVIWGDGITDYNPSLKSRLTVSKDTSKNQVSLKMSSLTAADTARYYCV TGLFDYWGQGTTLTVSSGGGGSGGGGSGGGGSGGGGSDAVVTQESALT SSPGETVTLTCRSSTGAVTTSNYASWVQEKPDHLFTGLIGGTNNRAPG VPARFSGSLIGDKAALTITGAQTEDEAIYFCVLWYSDHWVFGGGTKLT VLG | 374. | >H4(E6Q), muL_52SR4 |
| DVQLQESGPGLVAPSQSLSITCTVSGFLLTDYGVNWVRQSPGKGLEWL GVIWGDGITDYNSALKSRLSVTKDNSKSQVFLKMNSLQSGDSARYYCV TGLFDYWGQGTTLTVSSGGGGSGGGGSGGGGSGGGGSQAVVTQEPSLT VSPGGTVTLTCGSSTGAVTTSNYASWVQEKPDHLFRGLIGGTNNRAPG VPARFSGSLLGGKAALTISGAQPEDEAIYFCVLWYSDHWVFGGGTKLT VLG | 375. | >muH_52SR4, L5 |

TABLE 16

| Humanized sCAR scFV candidates omega) III | | |
|---|---|---|
| Sequence | Seq id no | Name |
| DIVMTQSPSSLSASVGDRVTITCRSSTGAVTTSNYASWVQEKPGKLFK GLIGGTNNRAPGVPSRFSGSLIGDKATLTISSLQPEDFATYFCALWYS NHWVFGQGTKVELKRGGGGSGGGGSGGGGSGGGGSEVKLLESGGGLV QPGGSLKLSCAVSGFSLTDYGVNWVRQAPGRGLEWIGVIWGDGITDYN SALKDRFIISKDNGKNTVYLQMSKVRSDDTALYYCVTGLFDYWGQGTL VTVSS | 376. | >Lambda |
| DIVMTQSPSSLSASVGDRVTITCRSSTGAVTTSNYASWVQEKPGKLFK GLIGGTNNRAPGVPSRFSGSLIGDKATLTISSLQPEDFATYFCALWYS NHWVFGQGTKVELKRGGGGSGGGGSGGGGSGGGGSEVKLLESGGGLV QPGGSLKLSCAVSGFSLTDYGVNWVRQAPGRGLEWIGVIWGDGITDYN SALKDRFIISKDDCENTVYLQMSKVRSDDTALYYCVTGLFDYWGQGTL VTVSS | 377. | >Omega |
| DIVMTQSPSSLSASVGDRVTITCRSSTGAVTTSNYASWVQEKPGKLFK GLIGGTNNRAPGVPSRFSGSLIGDKATLTISSLQPEDFATYYCALWYS NHWVFGQGTKVELKRGGGGSGGGGSGGGGSGGGGSEVKLLESGGGLV QPGGSLKLSCAVSGFSLTDYGVNWVRQAPGRGLEWIGVIWGDGTTDYN SALKDRFIISKDDCENTVYLQMSKVRSDDTALYYCVTGLFDYWGQGTL VTVSS | 378. | >Omega_m3 |
| DIVMTQSPSSLSASVGDRVTITCRSSTGAVTTSNYASWVQEKPGKLFK GLIGGTNNRAPGVPSRFSGSLIGDKATLTISSLQPEDFATYYCALWYS NHWVFGQGTKVELKRGGGGSGGGGSGGGGSGGGGSEVKLLESGGGLV QPGGSLKLSCAVSGFSLTDYGVNWVRQAPGRGLEWIGVIWGDGTTDYN SALKDRFIISKDDSENTVYLQMSKVRSDDTALYYCVTGLFDYWGQGTL VTVSS | 379. | >Omega_m3S |
| DIQMTQSPSSLSASVGDRVTITCRSSTGAVTTSNYASWVQQKPGKAFK GLIGGTNNRAPGVPSRFSGSGSGTDATLTISSLQPEDFATYYCALWYS NHWVFGQGTKVELKGGGGSGGGGSGGGGSSGGGSEVQLVESGGGLVQP GGSLRLSCAVSGFSLTDYGVNWVRQAPGKGLEWIGVIWGDGTTDYADS LKGRFTISKDDSKNTVYLQMNSVRAEDTAVYYCVTGLFDYWGQGTLVT VSS | 380. | >Omega2 |
| DIQMTQSPSSLSASVGDRVTITCRSSTGAVTTSNYASWVQQKPGKAFK GLIGGTNNRAPGVPSRFSGSLIGDKATLTISSLQPEDFATYYCALWYS NHWVFGQGTKVELKGGGGSGGGGSGGGGSSGGGSEVQLVESGGGLVQP GGSLRLSCAVSGFSLTDYGVNWVRQAPGKGLEWIGVIWGDGTTDYADS LKGRFTISKDDSKNTVYLQMNSVRAEDTAVYYCVTGLFDYWGQGTLVT VSS | 381. | >Omega3 |
| DIQMTQSPSSLSASVGDRVTITCRSSTGAVTTSNYASWVQQKPGKAFK GLIGGTNNRAPGVPSRFSGSLLGGKATLTISSLQPEDFATYYCALWYS NHWVFGQGTKVELKGGGGSGGGGSGGGGSSGGGSEVQLVESGGGLVQP GGSLRLSCAVSGFSLTDYGVNWVRQAPGKGLEWIGVIWGDGTTDYADS LKGRFTISKDDSKNTVYLQMNSVRAEDTAVYYCVTGLFDYWGQGTLVT VSS | 382. | >Omega4 |
| DIQMTQSPSSLSASVGDRVTITCRSSTGAVTTSNYASWVQQKPGKAFK GLIGGTNNRAPGVPSRFSGSLSGGKATLTISSLQPEDFATYYCALWYS NHWVFGQGTKVELKGGGGSGGGGSGGGGSSGGGSEVQLVESGGGLVQP GGSLRLSCAVSGFSLTDYGVNWVRQAPGKGLEWIGVIWGDGTTDYADS LKGRFTISKDDSKNTVYLQMNSVRAEDTAVYYCVTGLFDYWGQGTLVT VSS | 383. | >Omega5 |
| DIQMTQSPSSLSASVGDRVTITCRSSTGAVTTSNYASWVQQKPGKAFK GLIGGTNNRAPGVPSRFSGSGSGTDATLTISSLQPEDFATYYCALWYS NHWVFGQGTKVELKGGGGSGGGGSGGGGSSGGGSEVQLVESGGGLVQP GGSLRLSCAVSGFSLTDYGVNWVRQAPGKGLEWLGVIWGDGTTDYADS LKGRFTISKDNSKNTVYLQMNSLRAEDTAVYYCVTGLFDYWGQGTLLT VSS | 384. | >Omega6 |
| DIQMTQSPSSLSASVGDRVTITCRSSTGAVTTSNYASWVQQKPGKAFK GLIGGTNNRAPGVPSRFSGSLIGDKATLTISSLQPEDFATYYCALWYS NHWVFGQGTKVELKGGGGSGGGGSGGGGSSGGGSEVQLVESGGGLVQP GGSLRLSCAVSGFSLTDYGVNWVRQAPGKGLEWLGVIWGDGTTDYADS LKGRFTISKDNSKNTVYLQMNSLRAEDTAVYYCVTGLFDYWGQGTLLT VSS | 385. | >Omega7 |

TABLE 16-continued

Humanized sCAR scFV candidates omega) III

| Sequence | Seq id no | Name |
|---|---|---|
| DIQMTQSPSSLSASVGDRVTITCRSSTGAVTTSNYASWVQQKPGKAFK GLIGGTNNRAPGVPSRFSGSLLGGKATLTISSLQPEDFATYYCALWYS NHWVFGQGTKVELKGGGGSGGGGSGGGGSSGGGSEVQLVESGGGLVQP GGSLRLSCAVSGFSLTDYGVNWVRQAPGKGLEWLGVIWGDGTTDYADS LKGRFTISKDNSKNTVYLQMNSLRAEDTAVYYCVTGLFDYWGQGTLLT VSS | 386. | >Omega8 |
| DIQMTQSPSSLSASVGDRVTITCRSSTGAVTTSNYASWVQQKPGKAFK GLIGGTNNRAPGVPSRFSGSLSGGKATLTISSLQPEDFATYYCALWYS NHWVFGQGTKVELKGGGGSGGGGSGGGGSSGGGSEVQLVESGGGLVQP GGSLRLSCAVSGFSLTDYGVNWVRQAPGKGLEWLGVIWGDGTTDYADS LKGRFTISKDNSKNTVYLQMNSLRAEDTAVYYCVTGLFDYWGQGTLLT VSS | 387. | >Omega9 |
| EVQLVESGGGLVQPGGSLRLSCAASGFSLTDYGVNWVRQAPGKGLEWV SVIWGDGTTDYADSVKGRFTISRDNSKNTLYLQMNSLRAEDTAVYYCA RGLFDYWGQGTLVTVSSGGGGSGGGGSGGGGSSGGGSDIQMTQSPSSL SASVGDRVTITCRSSTGAVTTSNYASWYQQKPGKAPKLLIYGTNNRAP GVPSRFSGSGSGTDFTLTISSLQPEDFATYYCALWYSNHWVFGQGTKV EIK | 388. | >Omega10(HL) |

TABLE 17

Second & Third generation sCAR constructs

| Sequence | Seq id no | Name |
|---|---|---|
| DAVVTQESALTSSPGETVTLTCRSSTGAVTTSNYASWVQEKPDHLFTG LIGGTNNRAPGVPARFSGSLIGDKAALTITGAQTEDEAIYFCVLWYSD HWVFGGGTKLTVLGGGGSGGGGSGGGGSGGGGSDVQLQESGPGLVAP SQSLSITCTVSGFLLTDYGVNWVRQSPGKGLEWLGVIWGDGITDYNSA LKSRLSVTKDNSKSQVFLKMNSLQSGDSARYYCVTGLFDYWGQGTTLT VSSESKYGPPCPPCPDIYIWAPLAGTCGVLLLSLVITLYCKRGRKKLL YIFKQPFMRPVQTTQEEDGCSCRFPEEEEGGCELRVKFSRSADAPAYK QGQNQLYNELNLGRREEYDVLDKRRGRDPEMGGKPRRKNPQEGLYNEL QKDKMAEAYSEIGMKGERRRGKGHDGLYQGLSTATKDTYDALHMQALP PR | 389. | >TSY-2-193 |
| DAVVTQESALTSSPGETVTLTCRSSTGAVTTSNYASWVQEKPDHLFTG LIGGTNNRAPGVPARFSGSLIGDKAALTITGAQTEDEAIYFCVLWYSD HWVFGGGTKLTVLGGGGSGGGGSGGGGSGGGGSDVQLQESGPGLVAP SQSLSITCTVSGFLLTDYGVNWVRQSPGKGLEWLGVIWGDGITDYNSA LKSRLSVTKDNSKSQVFLKMNSLQSGDSARYYCVTGLFDYWGQGTTLT VSSESKYGPPCPPCPDFWVLVVVGGVLACYSLLVTVAFIIFWVKRGRK KLLYIFKQPFMRPVQTTQEEDGCSCRFPEEEEGGCELRVKFSRSADAP AYKQGQNQLYNELNLGRREEYDVLDKRRGRDPEMGGKPRRKNPQEGLY NELQKDKMAEAYSEIGMKGERRRGKGHDGLYQGLSTATKDTYDALHMQ ALPPR | 390. | >MM-02-107 |
| DAVVTQESALTSSPGETVTLTCRSSTGAVTTSNYASWVQEKPDHLFTG LIGGTNNRAPGVPARFSGSLIGDKAALTITGAQTEDEAIYFCVLWYSD HWVFGGGTKLTVLGGGGSGGGGSGGGGSGGGGSDVQLQESGPGLVAP SQSLSITCTVSGFLLTDYGVNWVRQSPGKGLEWLGVIWGDGITDYNSA LKSRLSVTKDNSKSQVFLKMNSLQSGDSARYYCVTGLFDYWGQGTTLT VSSESKYGPPCPPCPDFWVLVVVGGVLACYSLLVTVAFIIFWVRSKRS RLLHSDYMNMTPRRPGPTRKHYQPYAPPRDFAAYRSRVKFSRSADAPA YKQGQNQLYNELNLGRREEYDVLDKRRGRDPEMGGKPRRKNPQEGLYN ELQKDKMAEAYSEIGMKGERRRGKGHDGLYQGLSTATKDTYDALHMQA LPPR | 391. | >MM-02-083 |
| DAVVTQESALTSSPGETVTLTCRSSTGAVTTSNYASWVQEKPDHLFTG LIGGTNNRAPGVPARFSGSLIGDKAALTITGAQTEDEAIYFCVLWYSD HWVFGGGTKLTVLGGGGSGGGGSGGGGSGGGGSDVQLQESGPGLVAP SQSLSITCTVSGFLLTDYGVNWVRQSPGKGLEWLGVIWGDGITDYNSA LKSRLSVTKDNSKSQVFLKMNSLQSGDSARYYCVTGLFDYWGQGTTLT VSSIEVMYPPPYLDNEKSNGTIIHVKGKHLCPSPLFPGPSKPFWVLVV VGGVLACYSLLVTVAFIIFWVRSKRSRLLHSDYMNMTPRRPGPTRKHY QPYAPPRDFAAYRSRVKFSRSADAPAYKQGQNQLYNELNLGRREEYDV LDKRRGRDPEMGGKPRRKNPQEGLYNELQKDKMAEAYSEIGMKGERRR GKGHDGLYQGLSTATKDTYDALHMQALPPR | 392. | >MM-02-085 |

TABLE 17-continued

Second & Third generation sCAR constructs

| Sequence | Seq id no | Name |
|---|---|---|
| DAVVTQESALTSSPGETVTLTCRSSTGAVTTSNYASWVQEKPDHLFTG<br>LIGGTNNRAPGVPARFSGSLIGDKAALTITGAQTEDEAIYFCVLWYSD<br>HWVFGGGTKLTVLGGGGSGGGGSGGGGSGGGGSDVQLQESGPGLVAP<br>SQSLSITCTVSGFLLTDYGVNWVRQSPGKGLEWLGVIWGDGITDYNSA<br>LKSRLSVTKDNSKSQVFLKMNSLQSGDSARYYCVTGLFDYWGQGTTLT<br>VSSESKYGPPCPPCPDFWVLVVVGGVLACYSLLVTVAFIIFWVRSKRS<br>RLLHSDYMNMTPRRPGPTRKHYQPYAPPRDFAAYRSKRGRKKLLYIFK<br>QPFMRPVQTTQEEDGCSCRFPEEEEGGCELRVKFSRSADAPAYKQGQN<br>QLYNELNLGRREEYDVLDKRRGRDPEMGGKPRRKNPQEGLYNELQKDK<br>MAEAYSEIGMKGERRRGKGHDGLYQGLSTATKDTYDALHMQALPPR | 393. | >MM-02-084 |
| DAVVTQESALTSSPGETVTLTCRSSTGAVTTSNYASWVQEKPDHLFTG<br>LIGGTNNRAPGVPARFSGSLIGDKAALTITGAQTEDEAIYFCVLWYSD<br>HWVFGGGTKLTVLGGGGSGGGGSGGGGSGGGGSDVQLQESGPGLVAP<br>SQSLSITCTVSGFLLTDYGVNWVRQSPGKGLEWLGVIWGDGITDYNSA<br>LKSRLSVTKDNSKSQVFLKMNSLQSGDSARYYCVTGLFDYWGQGTTLT<br>VSSIEVMYPPPYLDNEKSNGTIIHVKGKHLCPSPLFPGPSKPFWVLVV<br>VGGVLACYSLLVTVAFIIFWVRSKRSRLLHSDYMNMTPRRPGPTRKHY<br>QPYAPPRDFAAYRSKRGRKKLLYIFKQPFMRPVQTTQEEDGCSCRFPE<br>EEEGGCELRVKFSRSADAPAYKQGQNQLYNELNLGRREEYDVLDKRRG<br>RDPEMGGKPRRKNPQEGLYNELQKDKMAEAYSEIGMKGERRRGKGHDG<br>LYQGLSTATKDTYDALHMQALPPR | 394. | >MM-02-086 |
| DIQMTQTTSSLSASLGDRVTISCRASQDISKYLNWYQQKPDGTVKLLI<br>YHTSRLHSGVPSRFSGSGSGTDYSLTISNLEQEDIATYFCQQGNTLPY<br>TFGGGTKLEITGGGGSGGGGSGGGGSEVKLQESGPGLVAPSQSLSVTC<br>TVSGVSLPDYGVSWIRQPPRKGLEWLGVIWGSETTYYNSALKSRLTII<br>KDNSKSQVFLKMNSLQTDDTAIYYCAKHYYYGGSYAMDYWGQGTSVTV<br>SSTTTPAPRPPTPAPTIASQPLSLRPEACRPAAGGAVHTRGLDFACDF<br>WVLVVVGGVLACYSLLVTVAFIIFWVRSKRSRLLHSDYMNMTPRRPGP<br>TRKHYQPYAPPRDFAAYRSRVKFSRSADAPAYKQGQNQLYNELNLGRR<br>EEYDVLDKRRGRDPEMGGKPRRKNPQEGLYNELQKDKMAEAYSEIGMK<br>GERRRGKGHDGLYQGLSTATKDTYDALHMQALPPR | 395. | >MM-02-109 |
| DIQMTQTTSSLSASLGDRVTISCRASQDISKYLNWYQQKPDGTVKLLI<br>YHTSRLHSGVPSRFSGSGSGTDYSLTISNLEQEDIATYFCQQGNTLPY<br>TFGGGTKLEITGGGGSGGGGSGGGGSEVKLQESGPGLVAPSQSLSVTC<br>TVSGVSLPDYGVSWIRQPPRKGLEWLGVIWGSETTYYNSALKSRLTII<br>KDNSKSQVFLKMNSLQTDDTAIYYCAKHYYYGGSYAMDYWGQGTSVTV<br>SSTTTPAPRPPTPAPTIASQPLSLRPEACRPAAGGAVHTRGLDFACDF<br>WVLVVVGGVLACYSLLVTVAFIIFWVRSKRSRLLHSDYMNMTPRRPGP<br>TRKHYQPYAPPRDFAAYRSKRGRKKLLYIFKQPFMRPVQTTQEEDGCS<br>CRFPEEEEGGCELRVKFSRSADAPAYKQGQNQLYNELNLGRREEYDVL<br>DKRRGRDPEMGGKPRRKNPQEGLYNELQKDKMAEAYSEIGMKGERRRG<br>KGHDGLYQGLSTATKDTYDALHMQALPPR | 396. | >MM-02-110 |
| DIQMTQTTSSLSASLGDRVTISCRASQDISKYLNWYQQKPDGTVKLLI<br>YHTSRLHSGVPSRFSGSGSGTDYSLTISNLEQEDIATYFCQQGNTLPY<br>TFGGGTKLEITGGGGSGGGGSGGGGSEVKLQESGPGLVAPSQSLSVTC<br>TVSGVSLPDYGVSWIRQPPRKGLEWLGVIWGSETTYYNSALKSRLTII<br>KDNSKSQVFLKMNSLQTDDTAIYYCAKHYYYGGSYAMDYWGQGTSVTV<br>SSTTTPAPRPPTPAPTIASQPLSLRPEACRPAAGGAVHTRGLDFACDI<br>YIWAPLAGTCGVLLLSLVITLYCKRGRKKLLYIFKQPFMRPVQTTQEE<br>DGCSCRFPEEEEGGCELRVKFSRSADAPAYKQGQNQLYNELNLGRREE<br>YDVLDKRRGRDPEMGGKPRRKNPQEGLYNELQKDKMAEAYSEIGMKGE<br>RRRGKGHDGLYQGLSTATKDTYDALHMQALPPR | 397. | >CART19 |

The CAR-antibody may have a binding affinity for the CAR-ID of less than about 0.01 pM, about 0.02 pM, about 0.03 pM, about 0.04 pM, 0.05 pM, about 0.06 pM, about 0.07 pM, about 0.08 pM, about 0.09 pM, about 0.1 pM, about 0.2 pM, 0.3 pM, about 0.4 pM, about 0.5 pM, about 0.6 pM, about 0.7 pM, about 0.8 pM, about 0.9 pM or about 1 pM, about 2 pM, about 3 pM, about 4 pM, about 5 pM, about 6 pM, about 7 pM, about 8 pM, about 9 pM, about 10 pM, about 0.01 nM, about 0.02 nM, about 0.03 nM, about 0.04 nM, about 0.05 nM, about 0.06 nM, about 0.07 nM, about 0.08 nM, about 0.09 nM, about 0.1 nM, about 0.2 nM, about 0.3 nM, about 0.4 nM, about 0.5 nM, about 0.6 nM, about 0.7 nM, about 0.8 nM, about 0.9 nM, about 1 nM, about 2 nM, about 2.5 nM, about 3 nM, about 4 nM, about 5 nM, about 6 nM, about 7 nM, about 8 nM, about 9 nM, about 10 nM, about 12 nM, about 14 nM, about 16 nM, about 18 nM, about 20 nM, about 22 nM, about 24 nM, about 26 nM, about 28 nM or about 30 nM.

The extracellular domain may comprise an anti-fluorescein isothiocyanate (FITC) antibody or a FITC-binding portion thereof. The anti-FITC antibody may be an anti-FITC scFv. The anti-FITC scFv may be selected from 4-4-20, 4D5Flu, 4M5.3 and FITC-E2. The anti-FITC scFv may be encoded by a sequence selected from SEQ ID NOs: 87-90.

The CAR-antibody may recognize a synthetic (non-naturally-occurring) peptide. The CAR-antibody may comprise an antibody or antibody fragment that recognizes a FLAG® tag or a fragment thereof. The CAR-antibody may comprise an antibody or antibody fragment that recognizes a yeast transcription factor GCN4 or a fragment thereof. The CAR-antibody may comprise an anti-HTP antibody or a fragment thereof.

The transmembrane domain and/or the intracellular domain may comprise at least a portion of a cytoplasmic signaling domain. The transmembrane domain may comprise a CD8 transmembrane sequence. The transmembrane domain may comprise a CD28 transmembrane sequence. The transmembrane domain may comprise a sequence that is at least 85%, 90%, 95%, 96%, 97%, 98%, or at least 99% identical to SEQ ID NO: 398 or SEQ ID NO: 417. The intracellular domain may comprise at least a portion of a signaling molecule selected from the group comprising CD3ζ, CD28, and 4-1BB. The intracellular domain may comprise (i) the CD3ζ sequence SEQ ID NO: 420, (ii) the CD28 sequence SEQ ID NO: 418, (iii) the 4-1BB sequence SEQ ID NO: 419, or a combination of (i) and (ii), (i) and (iii), (ii) and (iii), or all of (i)-(iii). The intracellular domain may comprise a sequence that is at least 85%, 90%, 95%, 96%, 97%, 98%, or at least 99% identical to the CD3ζ sequence SEQ ID NO: 420. The intracellular domain may comprise a sequence that is at least 85%, 90%, 95%, 96%, 97%, 98%, or at least 99% identical to the CD28 sequence SEQ ID NO: 418. The intracellular domain may comprise a sequence that is at least 85%, 90%, 95%, 96%, 97%, 98%, or at least 99% identical to the 4-1BB sequence SEQ ID NO: 419. The intracellular domain may comprise an Fc receptor or a portion thereof. The Fc receptor or portion thereof may be CD16 or a portion thereof. The signaling molecule may comprise CD3 ζ. The signaling molecule may comprise CD28. The signaling molecule may comprise 4-1BB. The intracellular domain may comprise at least a portion of CD3 ζ. The intracellular domain may comprise at least a portion of CD28, the intracellular domain may comprise at least a portion of 4-1BB, the intracellular domain may comprise at least a portion of OX-40, the intracellular domain may comprise at least a portion of CD30, the intracellular domain may comprise at least a portion of CD40, the intracellular domain may comprise at least a portion of CD2. The intracellular domain may comprise at least a portion of CD27. The intracellular domain may comprise at least a portion of PD-1. The intracellular domain may comprise at least a portion of ICOS. The intracellular domain may comprise at least a portion of lymphocyte function-associated antigen-1 (LFA-1). The intracellular domain may comprise at least a portion of CD7. The intracellular domain may comprise at least a portion of identical to lymphotoxins, inducible expression, competes with herpesvirus glycoprotein D for herpes virus entry mediator, a receptor expressed on T lymphocytes (LIGHT). The intracellular domain may comprise at least a portion of NKG2C. The intracellular domain may comprise at least a portion of B7-H3. The intracellular domain may comprise at least a portion of a cytoplasmic signaling domain from one or more signaling molecules. The intracellular domain may comprise at least a portion of two or more cytoplasmic signaling domains. The two or more cytoplasmic signaling domains may be from two or more different signaling molecules. The intracellular domain may comprise at least a portion of three or more cytoplasmic signaling domains. The intracellular domain may comprise at least a portion of four or more cytoplasmic signaling domains. The intracellular domain may comprise at least a portion of a ligand that binds to one or more signaling molecules. The intracellular domain may comprise at least a portion of a ligand that binds to CD83.

The CAR may comprise a hinge. The hinge may be located between the transmembrane domain and the extracellular domain. The hinge may comprise a portion of the transmembrane domain. The hinge may comprise a portion of the extracellular domain. The hinge may provide a length, orientation, geometry or flexibility to the CAR that is necessary for an optimal immunological synapse. The optimal immunological synapse may provide for an optimal distance and/or orientation between the CAR-EC and the target cell. The optimal immunological synapse may provide for optimal and/or maximal cytotoxicity against the target cell. As shown in Example 15 of PCT/US2016/027990, incorporated herein by reference in its entirety, CD19 targeting switches with FITC grafted proximal to the antigen binding interface of the FMC63 Fab, may be superior to switches with FITC grafted at the C-terminus. Although the epitope of anti-CD19 antibody FMC63 and corresponding structure of the CD19 antigen are not known, this may be due to a decreased distance between target cell and sCAR-T cell. In the physiological immunological synapse formed by the native T cell receptor (TCR), the distance between the T cell and antigen presenting cell is approximately 150 Å. This distance is critical to sterically exclude inhibitory phosphatases such as CD45 and CD148 from the synapse which act to dephosphorylate signaling molecules and down regulate T cell activation. It is likely that the longer synapse contributed by the C-terminal switches (65 Å longer than the N-terminal switches by length of Fab) is unable to sterically exclude these inhibitory molecules, resulting in less productive sCAR signaling. Thus, the methods disclosed herein may comprise modulating the distance of the immunological synapse by modulating the length of the switch and/or CAR extracellular domain such that the distance of the immunological synapse is not greater than about 100 Å, about 150 Å, about 175 Å, or about 200 Å.

In some embodiments, the optimal immunological synapse may be, e.g., no greater than about 100 Å, about 150 Å, about 175 Å, or about 200 Å.

The hinge may be derived from the extracellular domain of an endogenous transmembrane protein specific to T cell such as CD28 or 4-1BB, or components of CD3. The hinge may be derived from a synthetically derived sequence (such as the ones listed for linkers relevant to switch design). The hinge may be derived from a human protein. The hinge may be contiguous with the transmembrane domain. This hinge may comprise part of the heavy chain constant region 1 of the scFv). This hinge may comprise part of the light chain constant region 1 of the scFv).

The hinge length may be between about 1 amino acid and about 10 amino acids. The hinge length may be between 1 amino acid and about 20 amino acids. The hinge length may be between about 1 amino acid and about 50 amino acids. The hinge length may be between about 1 amino acid and about 100 amino acids. The hinge length may be between 10 amino acids and about 50 amino acids. The hinge length may be about 12 amino acids. The hinge length may be about 45 amino acids.

The hinge may be a long hinge. The long hinge may have a length of about 20 to about 200 amino acids, about 20 to about 100 amino acids, about 30 to about 100 amino acids, about 40 to about 100 amino acids, or about 45 to about 100 amino acids.

The hinge may be a short hinge. The short hinge may have a length of about 1 to about 20 amino acids, about 5 to about 20 amino acids, or about 10 to about 20 amino acids.

The hinge may comprise a portion of a CD8 protein. The portion of the CD8 protein may be between about 4 amino acids and about 100 amino acids. The portion of the CD8 protein may be about 45 amino acids. The hinge may comprise a portion of an immunoglobulin. The immunoglobulin may be an IgG. The immunoglobulin may be an IgG4. The IgG4 may be mutated (referred to herein as IgG4m). The portion of the immunoglobulin may be between about 1 amino acid and about 20 amino acids. The portion of the immunoglobulin may be about 12 amino acids.

The hinge may be flexible. The hinge may be structured.

As used herein in reference to a peptide sequence (e.g. a hinge or linker disclosed herein), the term "flexible" means a peptide sequence that comprises a linear sequence of amino acids with little or no known secondary structure. Such flexible sequences may comprise linear sequences of amino acids in which the torsion angles or rotation around the bonds of the polypeptide backbone have freedom to occupy many different orientations. In some embodiments, reference to a "flexible hinge" means that a hinge comprises a flexible peptide sequence that allows a CAR to bind CAR-IDs via various binging orientations, thus, alleviating steric hindrance that would otherwise have been detrimental to the CAR-ID binding the CAR extracellular domain.

As used herein in reference to a peptide sequence (e.g. a hinge or linker disclosed herein), the term "structured" means a peptide sequence that comprises a linear sequence of amino acids that forms a defined secondary structure. Such structured sequences may comprise a linear sequence of amino acids in which the torsion angles or rotation around the bonds of the polypeptide backbone have defined preferences to occupy a limited number of orientations. In some embodiments, a structured hinge may comprise a peptide sequence that defines the immunological synapse and reduces entropic costs of finding more productive orientation. Said another way, a structured hinge is, in some embodiments, a hinge that is not flexible. In various embodiments, the terms "rigid" and "structured," are used interchangeably in reference to a peptide sequence (e.g., a hinge or linker disclosed herein).

The hinge may comprise a sequence selected from SEQ ID NOS: 93-103. The hinge may comprise a sequence that is at least about 50% identical to a sequence selected from SEQ ID NOS: 93-103. The hinge may comprise a sequence selected from SEQ ID NOS: 165-168. The hinge may comprise a sequence that is at least about 50% identical to a sequence selected from 165-168. The hinge may comprise a sequence of SEQ ID NOS: 421. The hinge may comprise a sequence that is at least 50% identical to SEQ ID NOS: 421. The hinge may comprise a sequence that is at least 85%, 90%, 95%, 96%, 97%, 98%, or at least 99% identical to any one sequence selected form SEQ ID NOS: 165-168, and 421. The CAR having a hinge region may be encoded by a sequence selected from SEQ ID NOS: 181-183. The CAR having a hinge region may be encoded by a sequence that is at least about 50% identical to a sequence selected from SEQ ID NOS: 181-183. The hinge may consist of SEQ ID NO: 165. The hinge may comprise or consist of SEQ ID NO: 167. The hinge may comprise or consist of SEQ ID NO: 168. The hinge of SEQ ID NO: 168 may further comprise a c-terminal D residue. The hinge may comprise or consist of SEQ ID NO: 421. The hinge may comprise or consist of a sequence that is at least 50%, at least 60%, at least 70%, at least 80%, at least 85%, at least, at least 90%, at least 95%, at least 96%, at least, 97%, at least 98%, or at least 99% identical to SEQ ID NO: 165, SEQ ID NO: 167, SEQ ID NO: 168, or SEQ ID NO: 421.

The hinge may comprise a sequence that is identical to any one of SEQ ID NOS: 165, 167, 168, or 421 and the hinge may further comprise a sequence of SEQ ID NO: 166. For example, the IgG4m hinge sequence SEQ ID NO: 168, may further comprise a C-terminal D residue (SEQ ID NO: 166).

The CAR may be expressed at relatively low levels on the CAR-EC. The CAR may be expressed at relatively high levels on the CAR-EC. The CAR may be expressed at a cell density of less than about $2\times10^6$ receptors per cell. The CAR may be expressed at a cell density of about $0.5\times10^6$ receptors per cell. The CAR may be expressed at a cell density of more than about $0.05\times10^6$ per cell. The CAR may be expressed under the control of a promoter selected from EF1a, IL-2, CMV, and synthetic promoters designed to increase or decrease CAR expression. The promoter may be constitutive. The promoter may be inducible.

In some particular embodiments, the CAR comprises (a) an extracellular domain that comprises or consists of an scFv, (b) a hinge, (c) a transmembrane domain, and (d) an intracellular domain, wherein
   a. the scFv is selected from
      i. an scFv encoded by any one of the amino acid sequences provided in Tables 14-17;
      ii. an scFv encoded by any one of SEQ ID NOS: 290-388, and 423;
   b. the hinge is selected from
      i. an IgG4 hinge, an IgG4m hinge, a CD28 hinge, and a CD8 hinge;
      ii. a hinge comprising any one of SEQ ID NOS: 165, 167, 168, and 421; and
      iii. a hinge consisting of any one of SEQ ID NOS: 165, 167, 168, and 421;
   c. the transmembrane domain is selected from
      i. a CD8 transmembrane domain or a portion thereof or a CD28 transmembrane domain or a portion thereof;
      ii. a transmembrane domain comprising any one of SEQ ID NOS: 398 and 417
      iii. a transmembrane domain consisting of any one of SEQ ID NOS: 398 and 417 and
   d. the intracellular domain is selected from:
      i. an intracellular domain comprising a CD3ζ signaling molecule;
      ii. an intracellular domain comprising a CD3ζ signaling molecule and a CD28 signaling molecule;
      iii. an intracellular domain comprising a CD3ζ signaling molecule and a 4-1BB signaling molecule; and
      iv. an intracellular domain comprising a CD3ζ signaling molecule, a CD28 signaling molecule, and a 4-1BB signaling molecule.

Figure 24:
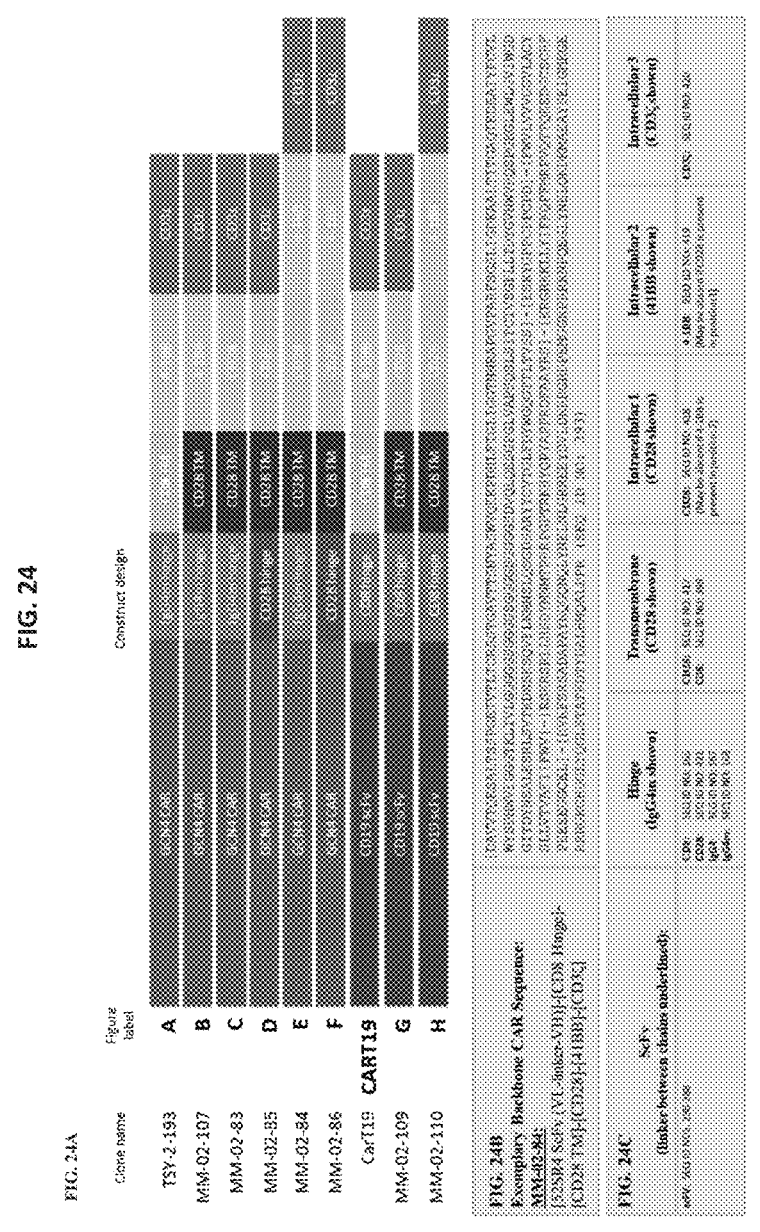

In some particular embodiments, the CAR comprises a structure selected from constructs A-H in FIG. 24A. In certain embodiments, the CAR comprises a structure according to construct E in FIG. 24A. In certain embodiments, the CAR is selected from the CARs described in Table 11. In certain particular embodiments, the CAR is selected from the CARs described in Table 12. In certain particular embodiments, the CAR comprises a sequence of any one of SEQ ID NOS: 401, 403, 405, 407, 409, 411, 413, and 415. In certain particular embodiments, the CAR comprises a sequence of any one of SEQ ID NOS: 389-397. In certain particular embodiments, the CAR consists of a sequence selected from SEQ ID NOS: 389-397, 401, 403, 405, 407, 409, 411, 413, and 415. In certain particular embodiments, the CAR comprises or consists of an amino acid sequence that is at least 50%, at least 60%, at least 70%, at least 80%, at least 85%, at least 90%, at least 95%, at least 96%, at least 97%, at least 98%, or at least 99% identical to a sequence. In certain particular embodiments, the CAR is encoded by a sequence selected from SEQ ID NOS: 400, 402, 404, 406, 408, 410, 412, 414, and 416.

Multivalent CARS

Valency can also be engineered into a CAR hinge (FIG. 17C). By way of non-limiting example, a monovalent switch may recruit two CARs through a disulfide that forms in the hinge region of the CAR. The hinge may be a CD8-derived hinge (SEQ ID NO. 165) which is expected to be monovalent. The hinge may be derived from the hinge region of an IgG molecule. The IgG molecule may be selected from IgG1, IgG4 or IgG4m (mutated). The IgG4 hinge (SEQ ID NO. 167) may not participate in interchain disulfides but instead has intrachain disulfide bonds which do not dimerize the CAR. The hinge may be considered functionally monovalent. The IgG1 and IgG4m hinge (SEQ ID NO. 168) may contain a serine to proline mutation which enables it to participate in interchain disulfide bonds which covalently dimerizes the hinge region (FIGS. 17A-17D). These hinges may be used to study both the distance constraints of an immunological synapse (by testing the long CD8-derived hinge vs the short IgG4 derived hinge) and the valency effect (by testing the short IgG4 derived hinge vs an IgG4m derived CAR) of the CAR and/or switch. Other hinges may comprise CH2 and/or CH3 of IgG1, IgG2, IgG3, or IgG4 molecules, or portions thereof, or combinations thereof. The hinge may be derived from CD28. The hinge may dimerize.

coCARS/iCARs

The switchable CARs and switches disclosed herein may encompass inhibitory chimeric antigen receptor (iCAR)-T cell switches and switchable iCAR-T cells for targeting an immune response to specific cells (e.g., diseased cells) and minimizing an immune attack on healthy cells. The switchable CARs and switches disclosed herein may also encompass co-stimulatory chimeric antigen receptor (coCAR)-T cell switches for use with switchable coCAR-T cells for targeting an immune response to target cells (e.g., diseased cells) and maximizing an immune attack on these cells. iCAR-T cell switches and coCAR-T cell switches comprise a CAR-binding domain and a target binding domain. Compositions disclosed herein may comprise a plurality of switches for modulating a chimeric antigen receptor-effector cell (CAR-EC), wherein a first switch that interacts with a first antigen on a first target cell and a first chimeric antigen receptor (CAR) on the CAR-EC; and a second switch that interacts with a second antigen on a second target cell and a second chimeric antigen receptor (CAR) on the CAR-EC. The plurality of switches may be used with existing CAR-T cells and with CAR-ECs that express a canonical CAR and/or an inhibitory CAR (iCAR). The plurality of switches may be used with existing CAR-T cells and with CAR-ECs that express a canonical CAR and/or a co-stimulatory CAR (coCAR).

The switchable CAR-EC cells disclosed herein may comprise a first switchable CAR and a second switchable CAR. The first switchable CAR may be a canonical CAR and the second switchable CAR may be an iCAR. The first switchable CAR may be a canonical CAR and the second switchable CAR may be a co-CAR.

The iCAR may comprise a chimeric receptor which provides an inhibitory signal to CAR-T cells. The iCAR may comprise a cytoplasmic domain selected from PD-1 or CTLA-4. The iCAR may be expressed by the same cell as a canonical (activating) CAR. Activation of the iCAR may tune down a canonical CAR signal and/or activity. The specificity of the iCAR can be used to protect tissues in which CAR-T cell activity is not desirable. iCAR activity may be controlled by a switch, referred to as an "iCAR switch" herein. Similarly, canonical CAR activity may be controlled by the first and/or second switch, referred to as an "aCAR switch" herein. A switchable iCAR-T cell enables targeting of antigens that may be unsafe to target with a canonical or CAR-T cell.

To mount an immune response, the aCAR switch binds a positive, or "A" antigen on a target cell that is to be attacked (e.g. cancer cell) and the canonical CAR, stimulating cytotoxic activity towards the target cell through activation of the canonical CAR. To protect normal tissue, the iCAR switch binds a negative, or "B", antigen on a cell that is to be avoided by T cells (e.g., a healthy cell) and the iCAR, inhibiting immune activity through signaling of the iCAR. The "B" antigen may be ubiquitously expressed on normal tissue but down-regulated in most malignant cells. The "A" antigen may be over-expressed in malignant cells relative to normal tissue. The B antigen may be opioid binding protein/cell adhesion molecule-like gene (OPCML). The B antigen may be selected from hyaluronidase 2 (HYAL2), deleted in colorectal cancer (DCC), and SMAR1.

The coCAR may comprise a chimeric receptor which provides a co-stimulatory signal to CAR-T cells. The coCAR may comprise a cytoplasmic domain selected from CD137 and/or CD28. The coCAR may be expressed by the same cell as a canonical (activating) CAR. Activation of the coCAR may enhance and/or synergize a canonical CAR signal and/or activity. The coCAR may increase cytotoxicity towards a target cell relative to the cytotoxicity towards a target cell generated by a CAR-T cell that only expresses a canonical CAR-T cell. coCAR activity may be controlled by a switch, referred to as an "coCAR switch" herein. Similarly, canonical CAR activity may be controlled by the first and/or second switch, referred to as an "aCAR switch" herein.

Non-Antibody CARs

In some embodiments, in contrast to conventional CARs, the chimeric antigen receptors disclosed herein may comprise a non-antibody extracellular domain that interacts with the CAR-ID. That is, the extracellular domain may comprise a non-antibody protein or a non-antibody peptide that interacts with the CAR-ID. Thus, the chimeric antigen receptor may not actually recognize an antigen on a target in the traditional sense of an antibody or antibody fragment recognizing an antigen, but interact with the target in ways that a non-antibody protein or peptide would. In these cases, the chimeric antigen receptor may be referred to more accurately as a "chimeric receptor." A person of skill in the art would understand that in many examples and descriptions throughout this disclosure, the chimeric antigen receptor may be a chimeric receptor. The chimeric receptor binding partner of the switch may be non-antibody protein or peptide. Thus, the chimeric receptor and the switch may have a protein-protein interaction or a protein-peptide interaction.

Protein-Protein Interactions

The CAR may comprise a non-antibody extracellular domain, wherein the extracellular domain comprises a non-antibody protein. The non-antibody protein may interact with the chimeric receptor binding partner, wherein the chimeric receptor binding partner comprises a chimeric receptor binding protein, constituting a protein-protein interaction. The protein-protein interaction may be loose. A loose interaction may be an interaction wherein the chimeric receptor binding partner and the non-antibody peptide bind with a KD of about 10-4 M, about 10-3 M, about 10-2 M, about 10-1 M, or with a KD that is larger than about 10-1 M. The protein-protein interaction may be a tight interaction. A tight interaction may be an interaction wherein the chimeric receptor binding partner and the non-antibody peptide bind with a KD of about 10-5 M, about 10-6 M, about 10-7 M, about 10-8 M, about 10-9 M, about 10-10 M, about 10-11 M or about 10-12 M. The protein-protein interaction may comprise a covalent protein-protein interaction. The protein-protein interaction may comprise a non-covalent protein-protein interaction. The non-antibody protein and/or chimeric receptor binding protein may comprise an enzyme. The enzyme may be a nuclease. The nuclease may be a ribonuclease. The ribonuclease may be prokaryotic. The non-antibody protein and/or chimeric receptor binding protein may comprise a substrate. The non-antibody protein may comprise barnase and the chimeric receptor binding protein may comprise barstar. The non-antibody protein may comprise barstar and the chimeric receptor binding protein may comprise barnase. Barnase is an amino acid ribonuclease from *Bacillus amyloliquefaciens*. Barstar is a natural intracellular inhibitor of barnase. Barnase interacts with barstar with high affinity, having a protein-protein binding on-rate of $10^8$/s/M (Buckle A M, Schreiber G, Fersht A R; Biochemistry 33 (30): 8878-8 (August 1994), incorporated herein by reference in its entirety). Barnase, barstar, and their interactions are described in Mossakowska D E, Nyberg K, Fersht A R; Biochemistry 28 (9): 3843-50 (May 1989), which is incorporated herein by reference in its entirety.

Protein-Peptide Interactions

The non-antibody protein may interact with the chimeric receptor binding partner, wherein the chimeric receptor binding partner comprises a CAR-ID, constituting a protein-peptide interaction. Alternatively, the non-antibody extracellular domain may comprise a non-antibody peptide that interacts with the chimeric receptor binding partner, wherein the chimeric receptor binding partner comprises a chimeric receptor binding protein, constituting the protein-peptide interaction. The protein-peptide interaction may be a loose interaction. A loose interaction may be an interaction wherein the chimeric receptor binding partner and the non-antibody peptide bind with a KD of about 10-4 M, about 10-3 M, about 10-2 M, about 10-1 M, or with a KD that is larger than about 10-1 M. The protein-peptide interaction may be a tight interaction. A tight interaction may be an interaction wherein the chimeric receptor binding protein and the non-antibody peptide (or the CAR-ID and the non-antibody protein) bind with KD of about 10-5 M, about 10-6 M, about 10-7 M, about 10-8 M, about 10-9 M, about 10-10 M, about 10-11 M or about 10-12 M. The non-antibody protein and/or chimeric receptor binding protein may be selected from a fibrous protein, an adhesion molecule protein and a membrane protein.

The protein-peptide interaction may comprise a covalent protein-peptide interaction. For example, the non-antibody protein may comprise a *Streptococcus pyogenes* pilin protein and the CAR-ID may comprise an isopeptag. Alternatively, the non-antibody peptide may comprise an isopeptag and the chimeric receptor binding protein may comprise a *Streptococcus pyogenes* pilin protein. The interactions between isopeptag and *Streptococcus pyogenes* pilin protein are described in Kang, H. J., Coulibaly, F., Clow, F., Proft, T., and Baker, E. N. Science 318, 1625-1628 (2007) and Zakeri, B. and Howarth, M.; J. Am. Chem. Soc. 132, 4526-4527 (2010), each of which is incorporated herein by reference in its entirety. The isopeptag sequence is SEQ ID NO: 41. Also, by way of non-limiting example, the non-antibody protein may comprise a *Streptococcus pyogenes* fibronectin binding protein (SpyCatcher), and the CAR-ID may comprise a SpyTag. Alternatively, the non-antibody peptide may comprise a SpyTag and the chimeric receptor binding protein may comprise a *Streptococcus pyogenes* fibronectin binding protein (SpyCatcher). The covalent interaction between SpyCatcher and SpyTag are described in Zakeri B, Howarth M, JACS, vol. 109 no. 12, (2012), which is incorporated herein by reference in its entirety.

The protein-peptide interaction may comprise a non-covalent protein-peptide interaction. For example, non-antibody protein may be selected from a synaptobrevin, a SNAP25 and a syntaxin, and portions thereof (e.g., alpha helix), and the CAR-ID may comprise a SNARE. Alternatively, the non-antibody peptide may comprise a SNARE and the chimeric receptor binding protein may be selected from a synaptobrevin, a SNAP25 and a syntaxin, and portions thereof (e.g., alpha helix). The interactions between SNARE and synaptobrevin, SNAP25 and a syntaxin are described in Söllner T, et al., Nature 362:318-324 (1993); Sutton R B, Fasshauer D, Jahn R, Brunger A T, Nature 395:347-353 (1998); and Darios, F, Proc. Natl. Acad. Sci. U.S.A 107, 18197-18201 (2010), each of which is incorporated herein by reference in its entirety. Also, by way of non-limiting example, the non-antibody protein may comprise an RNAseI and the CAR-ID may comprise a Hu-tag. Alternatively, the non-antibody peptide may comprise a Hu-tag and the chimeric receptor binding protein may comprise an RNAseI. Also, by way of non-limiting example, the non-antibody protein may comprise a HuS adapter protein and the CAR-ID may comprise a Hu-tag. Alternatively, the non-antibody peptide may comprise a Hu-tag and the chimeric receptor binding protein may comprise a HuS adapter protein. Interactions between Hu-tag and RNase I and Hu-tag and HuS adapter protein are described in Backer, M. V., et. al., Adapter protein for site-specific conjugation of payloads for targeted drug delivery. Bioconjugate Chem. 15, 1021-1029 (2004), which is incorporated herein by reference in its entirety.

Peptide-Peptide Interactions

The CAR may comprise a non-antibody extracellular domain, wherein the extracellular domain comprises a non-antibody peptide. The non-antibody peptide may interact with the chimeric receptor binding partner, wherein the chimeric receptor binding partner comprises a CAR-ID, constituting a peptide-peptide interaction. The peptide-peptide interaction may be a loose interaction. A loose interaction may be an interaction wherein the chimeric receptor binding partner and the non-antibody peptide bind with a KD of about 10-4 M, about 10-3 M, about 10-2 M, about 10-1 M, or with a KD that is larger than about 10-1 M. The peptide-peptide interaction may be a tight interaction. A tight interaction may be an interaction wherein the CAR-ID and the non-antibody peptide (or the CAR-ID and the non-antibody peptide) bind with a KD of about 10-5 M, about 10-6 M, about 10-7 M, about 10-8 M, about 10-9 M, about 10-10 M, about 10-11 M or about 10-12 M. The non-antibody peptide and/or CAR-ID may comprise be selected from a secondary structure of a protein (e.g., alpha helix, beta sheet), a protein domain, an enzyme domain, a dimerization domain, and a multimerization domain.

The peptide-peptide interaction may comprise a non-covalent peptide-peptide interaction. The non-antibody peptide may comprise a first alpha helix of a protein, and the CAR-ID may comprise a second alpha helix of a protein.

The first alpha helix and the second alpha helix may form a coiled coil structure. For example, but not to be limited in any way, the first peptide may be selected from any one of the E/K peptides disclosed in Litowski, J. R. (2002) (e.g., any one of SEQ ID NOS: 46-44, and 45-46, 47-58), and the second peptide may be selected from any peptide that is capable of forming an alpha helix with the first peptide. The second peptide may be an E/K peptide disclosed in Litowski (2002) (e.g., any one of SEQ ID NOS: 43-44, 45-46, 47-58) The non-antibody protein may comprise the K4 peptide (SEQ ID NO: 43) and the chimeric receptor binding protein may comprise the E4 peptide (SEQ ID NO: 44). The non-antibody protein may comprise the E4 peptide (SEQ ID NO: 44) and the chimeric receptor binding protein may comprise the K4 peptide (SEQ ID NO: 43). The interactions between the K4 and E4 peptides are described in Litowski, J. R., and R. S. Hodges. J Biol Chem, 277: 37272-9 (2002) and Woolfson, D. N., Adv Protein Chem, 70: 79-112 (2005), each of which is incorporated herein by reference in its entirety. The non-antibody protein may comprise a modified K4 peptide and the chimeric receptor binding protein may comprise a modified E4 peptide. The non-antibody protein may comprise a modified E4 peptide and the chimeric receptor binding protein may comprise a modified K4 peptide. The non-antibody protein may comprise a modified K4 peptide and the chimeric receptor binding protein may comprise the E4 peptide (SEQ ID NO: 44). The non-antibody protein may comprise a modified E4 peptide and the chimeric receptor binding protein may comprise a K4 peptide (SEQ ID NO: 43). The non-antibody protein may comprise the K4 peptide (SEQ ID NO: 33) and the chimeric receptor binding protein may comprise a modified E4 peptide. The non-antibody protein may comprise the E4 peptide (SEQ ID NO: 44) and the chimeric receptor binding protein may comprise a modified K4 peptide. The non-antibody protein may consist or consist essentially of a peptide having the sequence of SEQ ID NO: 43 and the chimeric receptor binding protein may consist or consist essentially of a peptide having the sequence of SEQ ID NO: 44. The non-antibody protein may consist or consist essentially of a peptide having the sequence of SEQ ID NO: 44 and the chimeric receptor binding protein may consist or consist essentially of a peptide having the sequence of SEQ ID NO: 43. The non-antibody protein may comprise a peptide having a sequence that has at least 85%, at least 90%, at least 95% or greater identity to SEQ ID NO: 43 and the chimeric receptor binding protein may comprise a peptide having a sequence that has at least 85%, at least 90%, at least 95% or greater identity to SEQ ID NO: 44. The non-antibody protein may comprise a peptide having a sequence that has at least 85%, at least 90%, at least 95% or greater identity to SEQ ID NO: 44 and the chimeric receptor binding protein may comprise a peptide having a sequence that has at least 85%, at least 90%, at least 95% or greater identity to SEQ ID NO: 43.

Also, by way of non-limiting example, the non-antibody peptide may comprise a first alpha helix of a mouse coronin 1A protein, and the CAR-ID may comprise a second alpha helix of a mouse coronin 1A protein. The coiled-coil interactions of mouse coronin 1A proteins are described in Kammerer R A, et al., Proc Natl Acad Sci USA 102:13891-13896 (2005), which is incorporated herein by reference in its entirety.

Also, by way of non-limiting example, the non-antibody peptide may comprise an anchoring domain (AD) of an A-kinase anchoring protein (AKAP) and the CAR-ID may comprise a dimerization and docking domain (DDD) of cAMP-dependent protein kinase A. The interaction of ADs with DDDs, known as the Dock and Lock system, have been describe in Rossi E A, Goldenberg D M, Chang C H, Bioconjug Chem. March 21; 23(3):309-23 (2012); Rossi E A, et. al., Proc Natl Acad Sci USA. May 2; 103(18):6841-6 (2006); and Backer M V, Patel V, Jehning B T, Backer J M., Bioconjug Chem. July-August; 17(4):912-9 (2006), each of which is incorporated herein by reference in its entirety.

Thus, by way of non-limiting example, the non-antibody peptide may comprise an anchoring domain (AD1) of an A-kinase anchoring protein and the CAR-ID may comprise a dimerization and docking domain (DDD1) of cAMP-dependent protein kinase A. Alternatively, the non-antibody peptide may comprise the DDD1 and the CAR-ID may comprise the anchoring domain (AD1).

The peptide-peptide interaction may comprise a covalent peptide-peptide interaction. By way of non-limiting example, the non-antibody peptide may comprise an anchoring domain (AD2) of an A-kinase anchoring protein and the CAR-ID may comprise a dimerization and docking domain (DDD2) of cAMP-dependent protein kinase A, wherein the AD2 and DDD2 have been modified with cysteines that form disulfide bonds between the AD and the DDD. Alternatively, the non-antibody peptide may comprise the DDD2 and the CAR-ID may comprise the AD2, wherein the AD2 and DDD2 have been modified with cysteines that form disulfide bonds between the AD2 and the DDD2. These disulfide bonds may form a covalent interaction between AD2 and the DDD2. This may be advantageous to increase affinity of the non-antibody peptide for the CAR-ID, or vice versa.

The effector cell may comprise a plurality of chimeric receptors. Two or more of the plurality of chimeric receptors may be the same. Two or more of the plurality of chimeric receptors may be different. Two or more of the plurality of chimeric receptors may each comprise an extracellular domain that comprises a DDD (e.g., DDD1 or DDD2). The DDDs of the two or more of the plurality of chimeric receptors may self-homo-multimerize, to produce multimerized DDDs. The DDDs may self-homo-dimerize, to produce dimerized DDDs. The multimerized or dimerized DDDs may bind to one or more ADs. The multimerized or dimerized DDDs bound to one or more ADs may increase signal transduction and/or activation of the effector cell, relative to a chimeric receptor that comprises one or no DDDs.

The chimeric receptor may comprise an extracellular domain, wherein the extracellular domain comprises the AD. The switch may comprise the DDD. The switch may be bivalent for the AD because the DDD self-homo-dimerizes upon binding the AD (e.g., see FIGS. 17A-17D). The DDD self-homo-dimerizing upon binding the AD may increase the avidity of the switch for the target cell and may improve the sensitivity of the switch for the target. This may be relevant for target cells with low surface density (or expression) of the cell surface molecule.

The switch may comprise the AD and the chimeric receptor may comprise the DDD (e.g., see FIG. 18) or the switch may comprise the DDD and the chimeric receptor may comprise the AD, resulting in a DDD/AD pair (e.g., see FIGS. 17A-17D). The DDD/AD pair may be smaller than an scFcv/peptide pair resulting from a chimeric antigen receptor comprising an scFv and a switch comprising a peptide, providing a size and geometry to the pair that is optimal for chimeric receptor binding to the chimeric receptor binding partner and subsequent chimeric receptor activation/signaling.

The chimeric effector receptor cell may be activated by multimerization of crosslinking multiple switches to multiple antigens on the target cell. The minimum number of switches to cause activation may be greater than two. The multimerized or dimerized DDDs may have generally potentiated signaling because it requires fewer crosslinks with switches than a canonical chimeric antigen receptor (e.g., without a dimerized/multimerized extracellular domain or portion thereof) to achieve activation.

Epsilon CAR

Further disclosed herein are chimeric antigen receptors comprising: an extracellular domain that interacts with an anti-CD3 antibody or fragment thereof on the switch; a transmembrane domain; and an intracellular domain, wherein at least a portion of the transmembrane domain or at least a portion of the intracellular domain is not based on or derived from a CD3 protein. The extracellular domain may comprise a CD3 extracellular domain or portion thereof. The extracellular domain may comprise a CD3 epsilon extracellular domain or portion thereof. The extracellular domain may comprise a CD3 delta extracellular domain or portion thereof. The extracellular domain may comprise a CD3 gamma extracellular domain or portion thereof. The extracellular domain may comprise a CD3 zeta extracellular domain or portion thereof. The extracellular domain may comprise an alpha chain of TCR extracellular domain or portion thereof. The extracellular domain may comprise a pre-alpha chain of TCR extracellular domain or portion thereof. The extracellular domain may comprise a beta chain of TCR extracellular domain or portion thereof.

VII. Kits, Vectors and Polynucleotides

Disclosed herein are kits comprising one or more CAR-EC switch disclosed herein. In some embodiments, the disclosure provides a kit comprising an anti-CD19 switch disclosed herein comprising a CAR-ID. In some embodiments, the disclosure provides a kit comprising a humanized anti-CD19 switch disclosed herein comprising a CAR-ID. In some embodiments, the disclosure provides a kit comprising a CAR-EC switch disclosed herein comprising a GCN4 derivative disclosed herein. In some embodiments, the disclosure provides a kit comprising an anti-CD19 switch disclosed herein comprising a GCN4 derivative disclosed herein. In some embodiments, the disclosure provides a kit comprising a humanized anti-CD19 switch disclosed herein comprising a GCN4 derivative disclosed herein. In some embodiments, the kit comprises a CAR-EC switch comprising a targeting moiety selected from an anti-CD19 antibody, an anti-CD20 antibody, an anti-CD22 antibody, an anti-EGFR antibody, an anti-EGFRvIII antibody, an anti-Her2 antibody, an anti-CS1 antibody, an anti-BCMA antibody, an anti-CEA antibody, an anti-CLL1 antibody, an anti-CD33 antibody, an anti-CD123 antibody, antigen binding portions of the aforementioned antibodies, and, optionally, humanized forms of the aforementioned antibodies (such as, e.g., any one of the humanized anti-CD19 antibodies disclosed herein).

In some embodiments, the kit comprises a CAR-EC switch or a pharmaceutical composition comprising such a switch, wherein the CAR-EC switch comprises a light chain and a heavy chain, wherein the light chain comprises or consists of any switch light chain sequence disclosed herein and the heavy chain comprises or consists of any switch heavy chain sequence disclosed herein. Such heavy and/or light chain sequences may be humanized. In some embodiments, the CAR-EC switch comprised in the kit is humanized and comprises a light chain sequence selected from SEQ ID NOS: 17-24 and a heavy chain sequence selected from SEQ ID NOS: 2-14, wherein one or both of the heavy and light chains comprise a CAR-ID disclosed herein (e.g., a GCN4 CAR-ID). In some particular embodiments, the light chain sequence comprises a humanized sequence selected from SEQ ID NOS: 27-34 (which comprise an N-terminal GCN4 CAR-ID) and a heavy chain sequence selected from SEQ ID NOS: 2-14. In some particular embodiments, the switch is a switch described in Table 6 or Table 8, which presents heavy chain/light chain combinations comprised in several of the switches disclosed herein. In some embodiments, the switch is identical to a switch described in Table 6 or Table 8, except that the CAR-ID comprised in the switch is modified to have a sequence of Structure I. In some embodiments, the sequence of Structure I is selected from any one of SEQ ID NOS: 26, 36, 139, and 154-163. The kit may comprise a single switch or a pharmaceutical composition comprising a single switch. The kit may comprise a plurality of switches or a pharmaceutical composition comprising a plurality of switches.

The kit may comprise two or more switches. The kit may comprise three switches. The kit may comprise about 3, 4, 5, 6, 7, 8, 9, 10, 12, 15, 20, 24, 30, 35, 48, 50, 55, 60, 65, 70, 75, 80, 85, 90, 96, 100, 120, 150, 200, 300, 384, 400, 500, 600, 700, 800, 900 or 1000 switches. The kit may be employed for biological research. The kit may be used for diagnosing a disease or a condition. The kit may be used for treating a disease or condition. The switches of the kit may be used with effector cells disclosed herein (e.g., CAR-ECs) or existing CAR T-cells clinically used or tested. The kit may comprise one or more effector cells. The effector cell may be a CAR-EC. The effector cell may be a T cell. The T cell may express one or more chimeric receptors. The T cell may be a CAR-T cell. The CAR-EC may bind the CAR-ID on the switch. The CAR-EC may bind a CAR-ID on the switch that is a peptide (e.g., a GCN4 peptide disclosed herein, a flag peptide disclosed herein, an alpha helix peptide that forms a coiled coil structure with another alpha helix peptide disclosed herein). The CAR-EC may bind a CAR-ID that is a small molecule (e.g., FITC). The CAR-T cell may bind the CAR-ID on the switch. The CAR-T cell may bind a CAR-ID on the switch that is a peptide (e.g., a GCN4 peptide or GCN4 derivative disclosed herein, a flag peptide disclosed herein, an alpha helix peptide that forms a coiled coil structure with another alpha helix peptide disclosed herein). The CAR-T cell may bind a CAR-ID that is a small molecule (e.g., FITC).

The kit may comprise a polynucleotide encoding one or more chimeric receptors (e.g., one or more chimeric receptors described herein). The kit may comprise a polynucleotide encoding one or more chimeric antigen receptors (e.g., one or more chimeric antigen receptors described herein). The kit may comprise a vector comprising a polynucleotide encoding one or more chimeric receptors. The chimeric receptor may be selected from any of the chimeric receptors disclosed herein. The chimeric receptor may be selected from any of the chimeric antigen receptors disclosed herein. The chimeric receptor may have any CAR sequence disclosed herein. The CAR may be humanized to reduce immunogenicity to humans. The CAR may comprise an extracellular domain that is humanized. The humanization may reduce immunogenicity of the CAR to humans while retaining the specificity and affinity of the extracellular domain for the CAR-EC switch. The CAR may be a humanized version of any one of the CAR sequences provided in Table 13. The CAR may be a humanized version of any one of SEQ ID NOS: 270-289. The CAR may be a humanized CAR comprising an extracellular domain that comprises an antibody or antibody fragment that binds to a CAR-ID of a CAR-EC switch. The antibody or antibody fragment may be humanized. The antibody fragment may be a scFv (e.g., a humanized scFv). The scFv or humanized scFv may comprise or consist of the general structure light chain-linker-heavy chain. The scFv or humanized scFv may comprise or consist of the general structure heavy chain-linker-light chain. The humanized scFv may comprise a humanized VH (variable heavy chain) sequence with non-human (e.g., murine) CDRs transplanted onto a human immunoglobulin framework. In some particular embodiments, the CAR comprises a structure selected from constructs A-H in FIG. 24A. In certain embodiments, the CAR comprises a structure according to construct A, construct B, or construct C in FIG. 24. In certain embodiments, the CAR is selected from the CARs described in Table 11. In certain particular embodiments, the CAR is selected from the CARs described in Table 12. The kit may comprise one or more polynucleotides encoding a chimeric receptor-EC switch disclosed herein or a portion thereof (e.g., antibody, antibody fragment, peptide).

Disclosed herein are vectors and polynucleotides encoding switches and portions thereof, wherein the switch comprises a GCN4 derivative and a polypeptide targeting moiety (e.g., a targeting protein or targeting peptide). Disclosed herein are and vectors and polynucleotides encoding humanized switches and portions thereof, wherein the switch comprises a CAR-ID and a humanized polypeptide targeting moiety (e.g., a targeting protein or targeting peptide). Disclosed herein are vectors and polynucleotides encoding switches and portions thereof, wherein the switch comprises a CAR-ID and a humanized polypeptide targeting moiety (e.g., a targeting protein or targeting peptide), wherein the polypeptide targeting moiety binds CD19 on a target cell. Disclosed herein are vectors and polynucleotides encoding switches and portions thereof, wherein the switch comprises a GCN4 derivative and a humanized polypeptide targeting moiety (e.g., a targeting protein or targeting peptide), wherein the polypeptide targeting moiety binds CD19 on a target cell. The polynucleotides may be DNA (e.g., cDNA). The polynucleotides may be RNA. In some embodiments, the targeting polypeptide may be a humanized anti-CD19 antibody or a CD19-binding fragment thereof. In some embodiments, the CAR-ID is a GCN4 peptide derivative disclosed herein. The vector may comprise a sequence encoding a heavy chain of the humanized anti-CD19 antibody or the CD19-binding fragment thereof. The vector may comprise a sequence encoding a light chain of the humanized anti-CD19 antibody or the CD19-binding fragment thereof. The vectors may comprise a sequence encoding a light chain of the humanized anti-CD19 antibody or the CD19-binding fragment thereof and a sequence encoding a heavy chain of the humanized anti-CD19 antibody or the CD19-binding fragment thereof. The light chain and the heavy chain may be expressed from the same vector. The light chain and the heavy chain may be expressed from two separate vectors. The heavy chain may comprise a humanized sequence. The light chain may comprise a humanized sequence. The heavy chain and the light chain may comprise a humanized sequence.

In some embodiments, the kits provide vectors and polynucleotides encoding chimeric receptors (e.g., CARs), wherein the CARs comprise an extracellular domain that binds to a peptide of a CAR-EC switch. The extracellular domain may comprise an antibody or antibody fragment. The antibody or antibody fragment may bind a CAR-ID of a CAR-EC. The CAR-ID may be a small molecule. The CAR-ID may be a hapten. The CAR-ID may be FITC or a derivative thereof. The CAR-ID may be a peptide. The CAR-ID may be a GCN4 peptide. The CAR-ID may be a GCN4 peptide that does not dimerize. The CAR-ID may be a GCN4 peptide disclosed herein. The CAR-ID may be a GCN4 peptide derivative. The CAR-ID may comprise a sequence of Structure I: X1NYHLENEVARLKX2X3 (SEQ ID NO: 269), wherein X1, X2, and X3 are optionally any amino acid or absent. The CAR-ID may comprise the sequence: NYHLENEVARLK (SEQ ID NO: 145). In some embodiments, the CAR-ID comprises or consists of a sequence selected from any one of SEQ ID NOS: 139, 154-163.

In some embodiments, the kits provide vectors and polynucleotides encoding chimeric receptors, wherein the chimeric receptors comprise a non-antibody extracellular domain. The non-antibody extracellular domain may not comprise an antibody or antibody fragment. The non-antibody extracellular domain may comprise a non-antibody protein. The non-antibody extracellular domain may comprise a non-antibody peptide. In some embodiments polynucleotide may have a sequence selected from SEQ ID NO: 68-84, 87-90, 104, and 181-183.

Vectors comprising sequences encoding chimeric receptors and/or chimeric receptor effector cell switches and portions thereof, disclosed herein, may be selected from any commercially available expression vector. The expression vector may be a prokaryotic expression vector. The expression vector may be a eukaryotic expression vector. The expression vector may be a mammalian expression vector. The expression vector may be a viral expression vector. The expression vector may have a constitutive promoter for constitutive expression of the chimeric receptor and/or switch encoding sequences. The expression vector may have an inducible promoter for conditional expression of the chimeric receptor and/or switch encoding sequences.

In some embodiments, the kit comprises (i) a CAR-EC switches comprising (a) a CAR-ID comprising a peptide from a yeast transcription factor GCN4 peptide; and (b) a humanized FMC63 antibody or an antigen binding portion thereof (e.g., any one of the humanized FMC63 antibodies described herein) and (ii) a CAR-EC expressing an anti-GCN4 CAR. The humanized FMC63 antibody or antibody fragment may comprise a heavy chain of a humanized FMC63 antibody. The heavy chain sequence may comprise any one of SEQ ID NOS: 2-15. The GCN4 may comprise a sequence of Structure I: $X_1$NYHLENEVARLK$X_2X_3$ (SEQ ID NO: 269), wherein $X_1$, $X_2$, and $X_3$ are all any amino acid or absent. The humanized FMC63 antibody or antibody fragment may comprise a light chain a humanized FMC63 antibody. The light chain sequence may comprise any one of SEQ ID NOS: 17-25 or any one of SEQ ID NOS: 27-35. The humanized FMC63 antibody or antibody fragment may comprise a Fab of a humanized FMC63 antibody. The humanized FMC63 antibody or antibody fragment may comprise a full length humanized FMC63 antibody or a fragment thereof. In some embodiments, use of the kit comprises co-treatment of a subject with (i) a CAR-EC switch comprising (a) a CAR-ID comprising a peptide from a yeast transcription factor peptide (e.g., a GCN4 peptide disclosed herein); and (b) a humanized FMC63 antibody or an antigen binding portion thereof (e.g., any one of the humanized FMC63 antibodies described herein) and (ii) a CAR-EC expressing an anti-GCN4 CAR, wherein the treatment results in switch mediated cytotoxicity of a CD19-expressing target cell.

In some embodiments, the kit comprises (i) a CAR-EC switches comprising (a) a CAR-ID comprising a Flag peptide; and (b) a humanized FMC63 antibody or an antigen binding portion thereof (e.g., any one of the humanized FMC63 antibodies described herein) and (ii) a CAR-EC expressing an anti-Flag peptide CAR. The Flag peptide may comprise any one of the following sequences: DYKDDDDK (SEQ ID NO:431) and DYKDDDDKP (SEQ ID NO:432). The humanized FMC63 antibody or antibody fragment may comprise a heavy chain of a humanized FMC63 antibody. The heavy chain sequence may comprise any one of SEQ ID NOS: 2-15. The humanized FMC63 antibody or antibody fragment may comprise a light chain a humanized FMC63 antibody. The light chain sequence may comprise any one of SEQ ID NOS: 17-25 or any one of SEQ ID NOS: 27-35. The humanized FMC63 antibody or antibody fragment may comprise a Fab of a humanized FMC63 antibody. The humanized FMC63 antibody or antibody fragment may comprise a full length humanized FMC63 antibody or a fragment thereof. In some embodiments, use of the kit comprises co-treatment of a subject with (i) a CAR-EC switch comprising (a) a CAR-ID comprising a Flag peptide; and (b) a humanized FMC63 antibody or an antigen binding portion thereof (e.g., any one of the humanized FMC63 antibodies described herein) and (ii) a CAR-EC expressing an anti-Flag CAR, wherein the treatment results in switch mediated cytotoxicity of a CD19-expressing target cell.

In some embodiments, the kit comprises (i) a CAR-EC switches comprising (a) a CAR-ID comprising FITC; and (b) a humanized FMC63 antibody or an antigen binding portion thereof (e.g., any one of the humanized FMC63 antibodies described herein) and (ii) a CAR-EC expressing an anti-FITC peptide CAR. The FITC may be conjugated to the humanized FMC63 antibody non-specifically. The FITC may be conjugated to the humanized FMC63 antibody site-specifically. The site-specific conjugation may be to an artificial amino acid comprised in the humanized FMC63 antibody. The conjugation may be via a linker that links the humanized FMC63 antibody to the FITC. The humanized FMC63 antibody or antibody fragment may comprise a heavy chain of a humanized FMC63 antibody. The heavy chain sequence may comprise any one of SEQ ID NOS: 2-15. The humanized FMC63 antibody or antibody fragment may comprise a light chain a humanized FMC63 antibody. The light chain sequence may comprise any one of SEQ ID NOS: 17-25 or any one of SEQ ID NOS: 27-35. The humanized FMC63 antibody or antibody fragment may comprise a Fab of a humanized FMC63 antibody. The humanized FMC63 antibody or antibody fragment may comprise a full length humanized FMC63 antibody or a fragment thereof. In some embodiments, use of the kit comprises co-treatment of a subject with (i) a CAR-EC switch comprising (a) a CAR-ID comprising a FITC; and (b) a humanized FMC63 antibody or an antigen binding portion thereof (e.g., any one of the humanized FMC63 antibodies described herein) and (ii) a CAR-EC expressing an anti-FITC CAR, wherein the treatment results in switch mediated cytotoxicity of a CD19-expressing target cell.

In some embodiments, the kit comprises (i) a CAR-EC switches comprising (a) a CAR-ID comprising a K4 peptide; and (b) a humanized FMC63 antibody or an antigen binding portion thereof (e.g., any one of the humanized FMC63 antibodies described herein) and (ii) a CAR comprising an E4 extracellular domain. The K4 peptide may comprise the amino acid sequence: KVAALKEKVAALKEKVAALKEK-VAALKE (SEQ ID NO:433). The E4 peptide may comprise the amino acid sequence: EVAALEKEVAALEKEV-AALEKEVAALEK (SEQ ID NO:434). The humanized FMC63 antibody or antibody fragment may comprise a heavy chain of a humanized FMC63 antibody. The heavy chain sequence may comprise any one of SEQ ID NOS: 2-15. The humanized FMC63 antibody or antibody fragment may comprise a light chain a humanized FMC63 antibody. The light chain sequence may comprise any one of SEQ ID NOS: 17-25 or any one of SEQ ID NOS: 27-35. The humanized FMC63 antibody or antibody fragment may comprise a Fab of a humanized FMC63 antibody. The humanized FMC63 antibody or antibody fragment may comprise a full length humanized FMC63 antibody or a fragment thereof. In some embodiments, use of the kit comprises co-treatment of a subject with (i) a CAR-EC switch comprising (a) a CAR-ID comprising a K4 peptide; and (b) a humanized FMC63 antibody or an antigen binding portion thereof (e.g., any one of the humanized FMC63 antibodies described herein) and (ii) a CAR-EC expressing a CAR comprising an E4 extracellular domain, wherein the treatment results in switch mediated cytotoxicity of a CD19-expressing target cell.

In some embodiments, the kit comprises (i) a CAR-EC switches comprising (a) a CAR-ID comprising a E4 peptide; and (b) a humanized FMC63 antibody or an antigen binding portion thereof (e.g., any one of the humanized FMC63 antibodies described herein) and (ii) a CAR comprising an K4 extracellular domain. The K4 peptide may comprise the amino acid sequence: KVAALKEKVAALKEKVAALKEK-VAALKE (SEQ ID NO:433). The E4 peptide may comprise the amino acid sequence: EVAALEKEVAALEKEV-AALEKEVAALEK (SEQ ID NO:434). The humanized FMC63 antibody or antibody fragment may comprise a heavy chain of a humanized FMC63 antibody. The heavy chain sequence may comprise any one of SEQ ID NOS: 2-15. The humanized FMC63 antibody or antibody fragment may comprise a light chain a humanized FMC63 antibody. The light chain sequence may comprise any one of SEQ ID NOS: 17-25 or any one of SEQ ID NOS: 27-35. The humanized FMC63 antibody or antibody fragment may comprise a Fab of a humanized FMC63 antibody. The humanized FMC63 antibody or antibody fragment may comprise a full length humanized FMC63 antibody or a fragment thereof. In some embodiments, use of the kit comprises co-treatment of a subject with (i) a CAR-EC switch comprising (a) a CAR-ID comprising a E4 peptide; and (b) a humanized FMC63 antibody or an antigen binding portion thereof (e.g., any one of the humanized FMC63 antibodies described herein) and (ii) a CAR-EC expressing a CAR comprising an K4 extracellular domain, wherein the treatment results in switch mediated cytotoxicity of a CD19-expressing target cell.

VIII. Therapeutic Use

Disclosed herein are methods, platforms and kits for treating a disease or condition in a subject in need thereof, the method comprising administering a chimeric antigen receptor effector cell (CAR-EC) switch to the subject, wherein the CAR-EC switch comprises: a CAR-ID and a targeting moiety. Such methods may further comprise administering a CAR-EC expressing a CAR that is complementary to the CAR-EC switch. The CAR-EC switch may be humanized. The CAR may be humanized.

Disclosed herein are methods, platforms and kits for treating a disease or condition in a subject in need thereof, the method comprising administering a chimeric antigen receptor effector cell (CAR-EC) switch to the subject, wherein the CAR-EC switch comprises: a GCN4 derivative disclosed herein and a targeting moiety (a "GCN4-switch").

Such methods may further comprise administering a CAR-EC expressing a CAR that is complementary to the GCN4-switch. The CAR-EC switch may be humanized. The CAR may be humanized.

Disclosed herein are methods, platforms and kits for treating a disease or condition in a subject in need thereof, the method comprising administering a chimeric antigen receptor effector cell (CAR-EC) switch to the subject, wherein the CAR-EC switch comprises: a GCN4 derivative disclosed herein and a targeting moiety that comprises or consists of an anti-CD19 antibody, or a CD19 binding portion thereof (an "anti-CD19 GCN4-switch"). The CD19 binding portion of the anti-CD19 antibody may be a scFv. The anti-CD19 GCN4-switch may be an LCNT switch. The anti-CD19 GCN4-switch may comprise a light chain and a heavy chain, wherein the light chain comprises or consists of any switch light chain sequence disclosed herein and the heavy chain comprises or consists of any switch heavy chain sequence disclosed herein. Such heavy and/or light chain sequences may be humanized.

Disclosed herein are methods, platforms and kits for treating a disease or condition in a subject in need thereof, the method comprising administering a chimeric antigen receptor effector cell (CAR-EC) switch to the subject, wherein the CAR-EC switch comprises: a GCN4 derivative disclosed herein and a targeting moiety that comprises or consists of a humanized anti-CD19 antibody, or a CD19 binding portion thereof. In some embodiments, the CAR-EC switch is humanized and comprises a light chain sequence selected from SEQ ID NOS: 17-24 and a heavy chain sequence selected from SEQ ID NOS: 2-14, wherein one or both of the heavy and light chains comprise a CAR-ID disclosed herein (e.g., a GCN4 CAR-ID). In particular embodiments, the light chain sequence comprises a humanized sequence selected from SEQ ID NOS: 27-34 (which comprise an N-terminal GCN4 CAR-ID) and a heavy chain sequence selected from SEQ ID NOS: 2-14. In particular embodiments, the switch is a switch described in Table 6 or Table 8, which presents heavy chain/light chain combinations comprised in several of the switches disclosed herein. In some embodiments, the switch is identical to a switch described in Table 6 or Table 8, except that the CAR-ID comprised in the switch is modified to have a sequence of Structure I. In some embodiments, the sequence of Structure I is selected from any one of SEQ ID NOS: 26, 36, 139, and 154-163. Such methods may further comprise administering a CAR-EC expressing a CAR that is complementary to the anti-CD19 GCN4-switch. The CAR may be humanized.

Disclosed herein are methods, platforms and kits for treating a disease or condition in a subject in need thereof, the method comprising administering a chimeric antigen receptor effector cell (CAR-EC) switch to the subject, wherein the CAR-EC switch comprises: a CAR-ID and a targeting moiety that comprises or consists of a humanized anti-CD19 antibody, or a CD19 binding portion thereof (an "anti-CD19 CAR-EC-switch"). The CD19 binding portion of the anti-CD19 antibody may be a scFv. The anti-CD19 CAR-EC switch may be an LCNT switch comprising an N-terminal CAR-ID. The anti-CD19 CAR-EC-switch may comprise a light chain and a heavy chain, wherein the light chain comprises or consists of any switch light chain sequence disclosed herein and the heavy chain comprises or consists of any switch heavy chain sequence disclosed herein. Such heavy and/or light chain sequences may be humanized. Such methods may further comprise administering a CAR-EC expressing a CAR that is complementary to the anti-CD19 CAR-EC-switch. The CAR may be humanized.

Disclosed herein are methods of treating a disease or condition in a subject in need thereof, the method comprising administering any one of the CAR-EC switches disclosed herein. Disclosed herein are methods of treating a disease or condition in a subject in need thereof, the method comprising administering any one of the CAR-EC switches disclosed herein and further administering a CAR-EC comprising a CAR that is complementary to the CAR-EC switch (i.e., the CAR comprises an extracellular domain with binding affinity for the CAR-ID comprised on the complementary CAR-EC switch).

In any of the methods disclosed herein of treating a disease or condition in a subject in need thereof, the CAR may be a CAR disclosed herein. The CAR may have any CAR sequence disclosed herein. The CAR may be humanized to reduce immunogenicity to humans. The CAR may comprise an extracellular domain that is humanized. The humanization may reduce immunogenicity of the CAR to humans while retaining the specificity and affinity of the extracellular domain for the CAR-EC switch. The CAR may be a humanized version of any one of the CAR sequences provided in Table 13 or it may be a humanized version of any one of SEQ ID NOS: 270-289. The CAR may be a humanized CAR comprising an extracellular domain that comprises an antibody or antibody fragment that binds to a CAR-ID of a CAR-EC switch. The antibody or antibody fragment may be humanized. The antibody fragment may be a scFv (e.g., a humanized scFv). The scFv or humanized scFv may comprise or consist of the general structure light chain-linker-heavy chain. The scFv or humanized scFv may comprise or consist of the general structure heavy chain-linker-light chain. The humanized scFv may comprise a humanized VH (variable heavy chain) sequence with non-human (e.g., murine) CDRs transplanted onto a human immunoglobulin framework. The humanized scFv may comprise a humanized VL (variable light chain) sequence with non-human (e.g., murine) CDRs transplanted onto a human immunoglobulin framework. In some particular embodiments, the CAR comprises a structure selected from constructs A-H in FIG. 24A. In certain embodiments, the CAR comprises a structure according to construct A, construct B, or construct C in FIG. 24. In certain embodiments, the CAR is selected from the CARs described in Table 11. In certain particular embodiments, the CAR is selected from the CARs described in Table 12. In certain embodiments, the extracellular domain of the CAR comprises a humanized scFv sequence selected from any one of SEQ ID NOS: 290-388, and 423.

In any of the methods disclosed herein of treating a disease or condition in a subject in need thereof, the disease or condition may be cancer. In some embodiments, the humanized anti-CD19 antibody, or a CD19 binding portion thereof comprises a light chain sequence and a heavy chain sequence. In some embodiments, the humanized anti-CD19 antibody, or a CD19 binding portion thereof comprises a humanized FMC63 antibody, or CD19 binding portion thereof. In some embodiments, the light chain sequence of the humanized anti-CD19 antibody, or a CD19 binding portion thereof, may comprise any one of SEQ ID NOS: 17-25 or any one of SEQ ID NOS: 27-35 and, alternatively or additionally, the heavy chain sequence may comprise any one of SEQ ID NOS: 2-15.

The methods disclosed herein of treating a disease or condition in a subject in need thereof may comprise administering a CAR-EC cell and one or more CAR-EC switches. The methods may comprise administering about 1, 2, 3, 4, 5, 6, 7, 8, 9, 10, 12, 15, 20, 24, 30, 35, 48, 50, 55, 60, 65, 70, 75, 80, 85, 90, 96, 100, 120, 150, 200, 300, 384, 400, 500, 600, 700, 800, 900, 1000 or more CAR-EC switches. The methods may comprise administering two or more CAR-EC switches. The two or more CAR-EC switches may comprise the same CAR-ID. The two more CAR-EC switches may comprise the same humanized anti-CD19 targeting moiety. The two or more CAR-EC switches may comprise one or more different CAR-IDs. The two more CAR-EC switches may comprise one or more different humanized anti-CD19 targeting moieties. The methods may comprise administering a plurality of CAR-EC cells and one or more CAR-EC switches. Administering the CAR-EC cell may comprise intravenous CAR-EC delivery. Administering the CAR-EC cell may comprise intraperitoneal CAR-EC delivery. Administering the CAR-EC cell may comprise intravenous CAR-EC delivery and intraperitoneal CAR-EC delivery. Administering the CAR-EC cell may occur once. Administering the CAR-EC cell may occur more than once (e.g., repeat injection). The CAR-ECs may be sorted to enrich a memory population of CAR-ECs before administering the CAR-ECs. The CAR-ECs may be subjected to iterative stimulation to enrich the memory population, as opposed to recursive stimulation which promotes exhaustion, provide for a long-lived, persistent phenotype. This rationale is based on natural acute infections with enrich long-lived memory cells through a 1-2 week long contraction phase that occurs after the challenge has been cleared. Similarly, the sCAR-T cell system in which adoptively transferred cells are rested following stimulation may more closely recapitulate a physiological duration of T cell activation.

Disclosed herein are methods of treating a disease or condition in a subject in need thereof, the method comprising administering a chimeric antigen receptor effector cell (CAR-EC) switch to the subject, wherein the CAR-EC switch comprises: a chimeric antigen receptor interacting domain (CAR-ID); and a humanized targeting moiety that binds CD19 on a target. The CAR-ID, by non-limiting example, may be selected from a FLAG® tag, a yeast transcription factor GCN4 (e.g., 7p14p GCN4, a hydrophilic target peptide (HTP), a peptide that forms an alpha helix. The targeting moiety, by non-limiting example may be selected from any of the humanized anti-CD19 antibodies disclosed herein.

The methods may comprise administering one or more chimeric antigen receptor effector cells to a subject in need thereof and then administering one or CAR-EC switches to a subject in need thereof. The amount or dose of CAR-EC switch may affect the magnitude of the chimeric antigen receptor effector cells toward the target cells, therefore the amount or dose of the CAR-EC switch may be titrated for a desired effect. For example, tumors may be targeted by titration of CAR-EC switch to achieve suitable therapeutic index. The response may be titrated "on" to avoid CRS (cytokine release syndrome) and TLS (tumor lysis syndrome) events, providing for personalized therapy. Furthermore, administration of a switch can be terminated in case of an adverse event, control of CAR-EC cell activity, titration of on-target off tumor reactivity or off target reactivity, abrogation of tumor lysis syndrome (TLS), or attenuation of cytokine release syndrome (CRS). The amount or dose may start at one level for a specified time period and then the amount or dose may be increased or decreased to a second level for a second specified time period. For example, the initial amount or dose of the CAR-EC switch may be the lowest dose necessary to eliminate the tumor. The amount or dose of the CAR-EC switch may then be increased to a larger dose in order to eliminate any remaining tumor cells. The methods may comprise terminating the administration of the CAR-EC switch once the tumor cells are eliminated. The methods may comprise re-administering the CAR-EC switch if the tumor cells re-occur in the patient or if the patient relapses.

The methods may comprise titrating the CAR-EC switch for a desired effect. Titrating the CAR-EC switch may enable antigen density discrimination. For example, the fatal on-target, off-tumor reactivity for Her2 targeted CAR-T cells to low levels of Her2 expression in the lung has tempered the application of CAR-T cells to solid tumors in the clinic. The use of a Fab-based switch that is expected to have a half-life of approximately 10 h in human allows a more rapid decrease in activity than long-live IgG-based molecules. The methods described herein may comprise titrating a switch to an optimal level wherein the switch activity may be affected by the density of the target antigen on the target cell, thereby discriminating or distinguishing the target antigen (and switch activity) on cancer cells from the target antigen on healthy tissue. In the clinic, this may be used to titrate therapy to an appropriate therapeutic index. Additionally, it may be possible in patients to decouple infusion of sCAR-T cells from activation by administering the switch only after adoptively transferred sCAR-T cells have cleared a tissue, thus mitigating potential toxicities to the tissue. For example, studies have shown that transferred cytotoxic T cells immediately accumulate in the lung, but the accumulation clears over 72 hours. One advantage of sCAR-T cells is that they can be transferred and the switch dose can be delayed until the sCAR-T cells have cleared the lung, during which time, the sCAR-T cells are inert. Once cleared, switch may be administered to activate the sCAR-T upon binding of the switch to the CAR and the target antigen. One skilled in the art would readily understand how this concept would apply to other antigens besides Her2 that are expressed on cells at varying densities.

The methods may comprise administering one or more chimeric antigen receptor effector cells. The methods may comprise administering one or more T cells. The one or more effector cells may be selected from a naive T cell, a memory stem cell T cell, a central memory T cell, an effector memory T cell, a helper T cell, a CD4+ T cell, a CD8+ T cell (cytotoxic T cell), a CD8/CD4+ T cell, an $\alpha\beta$ T cell, a $\gamma\delta$ T cell, a natural killer T cell, a natural killer cell, a macrophage.

The CAR-EC switch may have a therapeutic effect that is at least partially dependent on bringing an effector cell in proximity of a target cell. The therapeutic effect on the intended indication of the CAR-EC switch may be at least partially due to the CAR-EC switch recruiting an effector cell to the target cell. The therapeutic effect on the intended indication of the CAR-EC switch may be predominantly due to the CAR-EC switch recruiting an effector cell to the target cell. The therapeutic effect of the CAR-EC switch may be at least partially dependent on stimulating an immune response in the CAR-EC cell.

Administering the CAR-EC switch may not have any therapeutic effect without further administering an effector cell. The CAR-EC switch may not have a significant, desirable and/or intended therapeutic effect without further administering an effector cell. The CAR-EC switch may not have any therapeutic effect towards an intended indication of the CAR-EC platform without further administering an effector cell. A portion or component of the CAR-EC switch (e.g., CAR-ID or targeting moiety) may not have a therapeutic effect towards the intended indication of the CAR-EC switch without being conjugated to a second portion or component of the CAR-EC switch (e.g., CAR-ID or targeting moiety). The dose of a portion or component of the CAR-EC switch (e.g., CAR-ID or targeting moiety) when administered as part of the CAR-EC platform to provide a therapeutic effect may not have a therapeutic effect when the portion or component of the CAR-EC switch is administered alone at that dose. The portion or component of the CAR-EC switch may not be intended to have any therapeutic effect besides recruiting the T cell to the target cell. Administering the portion or component of the CAR-EC switch alone may have a therapeutic effect on the target cell, wherein the therapeutic effect is negligible relative to the therapeutic effect of administering the CAR-EC switch and the CAR-EC cell. Administering the portion or component of the CAR-EC switch may have a therapeutic effect on the target cell, wherein the therapeutic effect is less than the therapeutic effect of administering the CAR-EC switch and the CAR-EC cell.

Disclosed herein are uses of CAR-EC switches disclosed herein to treat a disease or condition in a subject in need thereof. Further disclosed herein are uses of CAR-EC switches disclosed herein in the manufacture of a medicament for the treatment of a disease.

Disclosed herein is use of a switch comprising a peptidic antigen that binds a CAR (CAR-ID) on an effector cell; and a targeting polypeptide that binds an antigen on a target to treat a disease or condition in a subject in need thereof. Further disclosed herein is use of a switch comprising a peptidic antigen (CAR-ID) that binds a CAR on an effector cell, wherein the CAR-ID; and a targeting polypeptide that binds an antigen on a target in the manufacture of a medicament for the treatment of a disease.

Disclosed herein is use of a CAR-EC switch comprising a CAR-ID, wherein the CAR-ID comprises a low immunogenicity peptide (e.g., FLAG) or derivative thereof and a targeting polypeptide, wherein the targeting polypeptide comprises an anti-CD19 antibody or fragment thereof; and an effector cell comprising a CAR, wherein the CAR comprises an anti-low immunogenicity peptide antibody, wherein the anti-CD19 antibody or fragment thereof binds CD19 on a B cell to treat a multiple myeloma. Notably, no previously reported antibody-based control system has reported targeting of CD19 in vivo. As reported herein, sCAR-T cell platforms were able to eliminate Nalm-6$^{Luc/}$$_{GFP}$ in vivo with comparable efficacy to conventional CART-19. Efficacy was reliant on optimal target cell engagement. More specifically, differences in the in vitro lytic activity of switch/hinge designs which were generally less than 10 fold in $EC_{50}$ were decisive for in vivo tumor elimination.

Disclosed herein is use of a CAR-EC switch comprising a CAR-ID, wherein the CAR-ID comprises a yeast transcription factor GCN4 or derivative thereof and a targeting polypeptide, wherein the targeting polypeptide comprises an anti-CD19 antibody or fragment thereof; and an effector cell comprising a CAR, wherein the CAR comprises an anti-GCN4 antibody, wherein the anti-CD19 antibody or fragment thereof binds CD19 on a lymphoblast, lymphocyte or B cell, to treat an acute lymphoblastic leukemia, a chronic lymphocytic leukemia or a B-cell lymphoma.

The disease or condition may be a cell proliferative disorder. The cell proliferative disorder may be selected from a solid tumor, a lymphoma, a leukemia and a liposarcoma. The cell proliferative disorder may be acute, chronic, recurrent, refractory, accelerated, in remission, stage I, stage II, stage III, stage IV, juvenile or adult. The cell proliferative disorder may be selected from myelogenous leukemia, lymphoblastic leukemia, myeloid leukemia, an acute myeloid leukemia, myelomonocytic leukemia, neutrophilic leukemia, myelodysplastic syndrome, B-cell lymphoma, burkitt lymphoma, large cell lymphoma, mixed cell lymphoma, follicular lymphoma, mantle cell lymphoma, hodgkin lymphoma, recurrent small lymphocytic lymphoma, hairy cell leukemia, multiple myeloma, basophilic leukemia, eosinophilic leukemia, megakaryoblastic leukemia, monoblastic leukemia, monocytic leukemia, erythroleukemia, erythroid leukemia and hepatocellular carcinoma. The cell proliferative disorder may comprise a hematological malignancy. The hematological malignancy may comprise a B cell malignancy. The cell proliferative disorder may comprise a chronic lymphocytic leukemia. The cell proliferative disorder may comprise an acute lymphoblastic leukemia. The cell proliferative disorder may comprise a CD19-positive Burkitt's lymphoma.

The disease or condition may be a cancer, a pathogenic infection, autoimmune disease, inflammatory disease, or genetic disorder.

In some instances, the one or more diseases comprise a cancer. The cancer may comprise a recurrent and/or refractory cancer. Examples of cancers include, but are not limited to, sarcomas, carcinomas, lymphomas or leukemias.

The cancer may comprise a neuroendocrine cancer. The cancer may comprise a pancreatic cancer. The cancer may comprise an exocrine pancreatic cancer. The cancer may comprise a thyroid cancer. The thyroid cancer may comprise a medullary thyroid cancer. The cancer may comprise a prostate cancer.

The cancer may comprise an epithelial cancer. The cancer may comprise a breast cancer. The cancer may comprise an endometrial cancer. The cancer may comprise an ovarian cancer. The ovarian cancer may comprise a stromal ovarian cancer. The cancer may comprise a cervical cancer.

The cancer may comprise a skin cancer. The skin cancer may comprise a neo-angiogenic skin cancer. The skin cancer may comprise a melanoma.

The cancer may comprise a kidney cancer.

The cancer may comprise a lung cancer. The lung cancer may comprise a small cell lung cancer. The lung cancer may comprise a non-small cell lung cancer.

The cancer may comprise a colorectal cancer. The cancer may comprise a gastric cancer. The cancer may comprise a colon cancer.

The cancer may comprise a brain cancer. The brain cancer may comprise a brain tumor. The cancer may comprise a glioblastoma. The cancer may comprise an astrocytoma.

The cancer may comprise a blood cancer. The blood cancer may comprise a leukemia. The leukemia may comprise a myeloid leukemia. The cancer may comprise a lymphoma. The lymphoma may comprise a non-Hodgkin's lymphoma.

The cancer may comprise a sarcoma. The sarcoma may comprise an Ewing's sarcoma.

Sarcomas are cancers of the bone, cartilage, fat, muscle, blood vessels, or other connective or supportive tissue. Sarcomas include, but are not limited to, bone cancer, fibrosarcoma, chondrosarcoma, Ewing's sarcoma, malignant hemangioendothelioma, malignant schwannoma, bilateral vestibular schwannoma, osteosarcoma, soft tissue sarcomas (e.g., alveolar soft part sarcoma, angiosarcoma, cystosarcoma phylloides, dermatofibrosarcoma, desmoid tumor, epithelioid sarcoma, extraskeletal osteosarcoma, fibrosarcoma, hemangiopericytoma, hemangiosarcoma, Kaposi's sarcoma, leiomyosarcoma, liposarcoma, lymphangiosarcoma, lymphosarcoma, malignant fibrous histiocytoma, neurofibrosarcoma, rhabdomyosarcoma, and synovial sarcoma).

Carcinomas are cancers that begin in the epithelial cells, which are cells that cover the surface of the body, produce hormones, and make up glands. By way of non-limiting example, carcinomas include breast cancer, pancreatic cancer, lung cancer, colon cancer, colorectal cancer, rectal cancer, kidney cancer, bladder cancer, stomach cancer, prostate cancer, liver cancer, ovarian cancer, brain cancer, vaginal cancer, vulvar cancer, uterine cancer, oral cancer, penile cancer, testicular cancer, esophageal cancer, skin cancer, cancer of the fallopian tubes, head and neck cancer, gastrointestinal stromal cancer, adenocarcinoma, cutaneous or intraocular melanoma, cancer of the anal region, cancer of the small intestine, cancer of the endocrine system, cancer of the thyroid gland, cancer of the parathyroid gland, cancer of the adrenal gland, cancer of the urethra, cancer of the renal pelvis, cancer of the ureter, cancer of the endometrium, cancer of the cervix, cancer of the pituitary gland, neoplasms of the central nervous system (CNS), primary CNS lymphoma, brain stem glioma, and spinal axis tumors. In some instances, the cancer is a skin cancer, such as a basal cell carcinoma, squamous, melanoma, nonmelanoma, or actinic (solar) keratosis.

In some instances, the cancer is a lung cancer. Lung cancer may start in the airways that branch off the trachea to supply the lungs (bronchi) or the small air sacs of the lung (the alveoli). Lung cancers include non-small cell lung carcinoma (NSCLC), small cell lung carcinoma, and mesotheliomia. Examples of NSCLC include squamous cell carcinoma, adenocarcinoma, and large cell carcinoma. The mesothelioma may be a cancerous tumor of the lining of the lung and chest cavity (pleura) or lining of the abdomen (peritoneum). The mesothelioma may be due to asbestos exposure. The cancer may be a brain cancer, such as a glioblastoma.

Alternatively, the cancer may be a central nervous system (CNS) tumor. CNS tumors may be classified as gliomas or nongliomas. The glioma may be malignant glioma, high grade glioma, diffuse intrinsic pontine glioma. Examples of gliomas include astrocytomas, oligodendrogliomas (or mixtures of oligodendroglioma and astocytoma elements), and ependymomas. Astrocytomas include, but are not limited to, low-grade astrocytomas, anaplastic astrocytomas, glioblastoma multiforme, pilocytic astrocytoma, pleomorphic xanthoastrocytoma, and subependymal giant cell astrocytoma. Oligodendrogliomas include low-grade oligodendrogliomas (or oligoastrocytomas) and anaplastic oligodendriogliomas. Nongliomas include meningiomas, pituitary adenomas, primary CNS lymphomas, and medulloblastomas. In some instances, the cancer is a meningioma.

The leukemia may be an acute lymphocytic leukemia, acute myelocytic leukemia, chronic lymphocytic leukemia, or chronic myelocytic leukemia. Additional types of leukemias include hairy cell leukemia, chronic myelomonocytic leukemia, and juvenile myelomonocytic leukemia.

Lymphomas are cancers of the lymphocytes and may develop from either B or T lymphocytes. The two major types of lymphoma are Hodgkin's lymphoma, previously known as Hodgkin's disease, and non-Hodgkin's lymphoma. Hodgkin's lymphoma is marked by the presence of the Reed-Sternberg cell. Non-Hodgkin's lymphomas are all lymphomas which are not Hodgkin's lymphoma. Non-Hodgkin lymphomas may be indolent lymphomas and aggressive lymphomas. Non-Hodgkin's lymphomas include, but are not limited to, diffuse large B cell lymphoma, follicular lymphoma, mucosa-associated lymphatic tissue lymphoma (MALT), small cell lymphocytic lymphoma, mantle cell lymphoma, Burkitt's lymphoma, mediastinal large B cell lymphoma, Waldenström macroglobulinemia, nodal marginal zone B cell lymphoma (NMZL), splenic marginal zone lymphoma (SMZL), extranodal marginal zone B cell lymphoma, intravascular large B cell lymphoma, primary effusion lymphoma, and lymphomatoid granulomatosis.

The cancer may comprise a solid tumor. The cancer may comprise a sarcoma. The cancer may be selected from a group consisting of a bladder cancer, a breast cancer, a colon cancer, a rectal cancer, an endometrial cancer, a kidney cancer, a lung cancer, melanoma, a myeloma, a thyroid cancer, a pancreatic cancer, a glioma, a malignant glioma of the brain, a glioblastoma, an ovarian cancer, and a prostate cancer. The cancer may have non-uniform antigen expression. The cancer may have modulated antigen expression. The antigen may be a surface antigen. The cancer may not comprise a myeloma. The cancer may not comprise a melanoma. The cancer may not comprise a colon cancer. The cancer may be acute lymphoblastic leukemia (ALL). The cancer may be relapsed ALL. The cancer may be refractory ALL. The cancer may be relapsed, refractory ALL. The cancer may be chronic lymphocytic leukemia (CLL). The cancer may be relapsed CLL. The cancer may be refractory CLL. The cancer may be relapsed, refractory CLL.

The cancer may comprise a breast cancer. The breast cancer may be triple positive breast cancer (estrogen receptor, progesterone receptor and Her2 positive). The breast cancer may be triple negative breast cancer (estrogen receptor, progesterone receptor and Her2 negative). The breast cancer may be estrogen receptor positive. The breast cancer may be estrogen receptor negative. The breast cancer may be progesterone receptor positive. The breast cancer may be progesterone receptor negative. The breast cancer may comprise a Her2 negative breast cancer. The breast cancer may comprise a low-expressing Her2 breast cancer. The breast cancer may comprise a Her2 positive breast cancer. Cell lines expressing Her2 have been well-characterized for antigen density, reflecting clinical immunohistochemistry characterization which classifies malignancies as 0 (<20,000 Her2 antigens per cell), 1+ (100,000 Her2 antigens per cell), 2+ (500,000 Her2 antigens per cell), and 3+ (>2,000,000 Her2 antigens per cell). The present invention provides for methods of treating breast cancers of these classifications. The breast cancer may comprise a breast cancer classified as Her2 0. The breast cancer may comprise a breast cancer classified as Her2 1+. The breast cancer may comprise a breast cancer classified as Her2 2+. The breast cancer may comprise a breast cancer classified as a Her2 3+.

The disease or condition may be a pathogenic infection. Pathogenic infections may be caused by one or more pathogens. In some instances, the pathogen is a bacterium, fungi, virus, or protozoan.

Exemplary pathogens include but are not limited to: *Bordetella, Borrelia, Brucella, Campylobacter, Chlamydia, Chlamydophila, Clostridium, Corynebacterium, Enterococcus, Escherichia, Francisella, Haemophilus, Helicobacter, Legionella, Leptospira, Listeria, Mycobacterium, Mycoplasma, Neisseria, Pseudomonas, Rickettsia, Salmonella, Shigella, Staphylococcus, Streptococcus, Treponema, Vibrio,* or *Yersinia*. In some cases, the disease or condition caused by the pathogen is tuberculosis and the heterogeneous sample comprises foreign molecules derived from the bacterium *Mycobacterium tuberculosis* and molecules derived from the subject. In some instances, the disease or condition is caused by a bacterium is tuberculosis, pneumonia, which may be caused by bacteria such as *Streptococcus* and *Pseudomonas*, a foodborne illness, which may be caused by bacteria such as *Shigella, Campylobacter* and *Salmonella*, and an infection such as tetanus, typhoid fever, diphtheria, syphilis and leprosy. The disease or condition may be bacterial vaginosis, a disease of the vagina caused by an imbalance of naturally occurring bacterial flora. Alternatively, the disease or condition is a bacterial meningitis, a bacterial inflammation of the meninges (e.g., the protective membranes covering the brain and spinal cord). Other diseases or conditions caused by bacteria include, but are not limited to, bacterial pneumonia, a urinary tract infection, bacterial gastroenteritis, and bacterial skin infection. Examples of bacterial skin infections include, but are not limited to, impetigo which may be caused by *Staphylococcus aureus* or *Streptococcus pyogenes*; erysipelas which may be caused by a *Streptococcus* bacterial infection of the deep epidermis with lymphatic spread; and cellulitis which may be caused by normal skin flora or by exogenous bacteria.

The pathogen may be a fungus, such as, *Candida, Aspergillus, Cryptococcus, Histoplasma, Pneumocystis*, and *Stachybotrys*. Examples of diseases or conditions caused by a fungus include, but are not limited to, jock itch, yeast infection, ringworm, and athlete's foot.

The pathogen may be a virus. Examples of viruses include, but are not limited to, adenovirus, coxsackievirus, Epstein-Barr virus, Hepatitis virus (e.g., Hepatitis A, B, and C), herpes simplex virus (type 1 and 2), cytomegalovirus, herpes virus, HIV, influenza virus, measles virus, mumps virus, papillomavirus, parainfluenza virus, poliovirus, respiratory syncytial virus, rubella virus, and varicella-zoster virus. Examples of diseases or conditions caused by viruses include, but are not limited to, cold, flu, hepatitis, AIDS, chicken pox, rubella, mumps, measles, warts, and poliomyelitis.

The pathogen may be a protozoan, such as *Acanthamoeba* (e.g., *A. astronyxis, A. castellanii, A. culbertsoni, A. hatchetti, A. polyphaga, A. rhysodes, A. healyi, A. divionensis*), *Brachiola* (e.g., *B connori, B. vesicularum*), *Cryptosporidium* (e.g., *C. parvum*), *Cyclospora* (e.g., *C. cayetanensis*), *Encephalitozoon* (e.g., *E. cuniculi, E. hellem, E. intestinalis*), *Entamoeba* (e.g., *E. histolytica*), *Enterocytozoon* (e.g., *E. bieneusi*), *Giardia* (e.g., *G. lamblia*), *Isospora* (e.g, *I. belli*), *Microsporidium* (e.g., *M. africanum, M. ceylonensis*), *Naegleria* (e.g., *N. fowleri*), *Nosema* (e.g., *N. algerae, N. ocularum*), *Pleistophora, Trachipleistophora* (e.g., *T. anthropophthera, T. hominis*), and *Vittaforma* (e.g., *V. corneae*).

The disease or condition may be an autoimmune disease or autoimmune related disease. An autoimmune disorder may be a malfunction of the body's immune system that causes the body to attack its own tissues. Examples of autoimmune diseases and autoimmune related diseases include, but are not limited to, Addison's disease, alopecia areata, ankylosing spondylitis, antiphospholipid syndrome (APS), autoimmune aplastic anemia, autoimmune hemolytic anemia, autoimmune hepatitis, autoimmune myocarditis, Behcet's disease, celiac sprue, Crohn's disease, dermatomyositis, eosinophilic fasciitis, erythema nodosum, giant cell arteritis (temporal arteritis), Goodpasture's syndrome, Graves' disease, Hashimoto's disease, idiopathic thrombocytopenic purpura (ITP), IgA nephropathy, juvenile arthritis, diabetes, juvenile diabetes, Kawasaki syndrome, Lambert-Eaton syndrome, lupus (SLE), mixed connective tissue disease (MCTD), multiple sclerosis, myasthenia gravis, pemphigus, polyarteritis nodosa, type I, II, & III autoimmune polyglandular syndromes, polymyalgia rheumatica, polymyositis, psoriasis, psoriatic arthritis, Reiter's syndrome, relapsing polychondritis, rheumatoid arthritis, sarcoidosis, scleroderma, Sjogren's syndrome, sperm & testicular autoimmunity, stiff person syndrome, Takayasu's arteritis, temporal arteritis/giant cell arteritis, ulcerative colitis, uveitis, vasculitis, vitiligo, and Wegener's granulomatosis.

The disease or condition may be an inflammatory disease. Examples of inflammatory diseases include, but are not limited to, alveolitis, amyeloidosis, angiitis, ankylosing spondylitis, avascular necrosis, Basedow's disease, Bell's palsy, bursitis, carpal tunnel syndrome, celiac disease, cholangitis, chondromalacia patella, chronic active hepatitis, chronic fatigue syndrome, Cogan's syndrome, congenital hip dysplasia, costochondritis, Crohn's Disease, cystic fibrosis, De Quervain's tendinitis, diabetes associated arthritis, diffuse idiopathic skeletal hyperostosis, discoid lupus, Ehlers-Danlos syndrome, familial mediterranean fever, fascitis, fibrositis/fibromyalgia, frozen shoulder, ganglion cysts, giant cell arteritis, gout, Graves' Disease, HIV-associated rheumatic disease syndromes, hyperparathyroid associated arthritis, infectious arthritis, inflammatory bowel syndrome/irritable bowel syndrome, juvenile rheumatoid arthritis, lyme disease, Marfan's Syndrome, Mikulicz's Disease, mixed connective tissue disease, multiple sclerosis, myofascial pain syndrome, osteoarthritis, osteomalacia, osteoporosis and corticosteroid-induced osteoporosis, Paget's Disease, palindromic rheumatism, Parkinson's Disease, Plummer's Disease, polymyalgia rheumatica, polymyositis, pseudogout, psoriatic arthritis, Raynaud's Phenomenon/Syndrome, Reiter's Syndrome, rheumatic fever, rheumatoid arthritis, sarcoidosis, sciatica (lumbar radiculopathy), scleroderma, scurvy, sickle cell arthritis, Sjogren's Syndrome, spinal stenosis, spondyloisthesis, Still's Disease, systemic lupus erythematosis, Takayasu's (Pulseless) Disease, Tendinitis, tennis elbow/golf elbow, thyroid associated arthritis, trigger finger, ulcerative colitis, Wegener's Granulomatosis, and Whipple's Disease.

Methods of treatment disclosed herein may comprise off-target activity as measured by cytokine levels. The method may reduce the off-target activity, as measured by cytokine levels, when compared to other CAR-EC therapies. The method may reduce the off-target activity as measured by interferon gamma levels. Other off-target activities that may be reduced include toxic lymphophenia, fatal cytolysis of solid tumor targets and chronic hypogammaglobulinemia for hematological targets. Methods of treatment and compositions disclosed herein may be used to treat a cancer comprising CD19-mediated B cell aplasia. The methods and compositions may minimize the CD19-mediated B cell aplasia. The method may avoid long-term B-cell aplasia.

The CAR-EC platforms, methods and compositions disclosed herein may be used to treat a heterogeneous tumor or a heterogeneous blood cell malignancy in a subject in need thereof. The "pan-B cell" marker CD20 is the most prevalently targeted antigen for B cell neoplasms and the FDA-approved antibody rituximab is a vital component in the treatment of many leukemias and lymphomas. However, resistance mechanisms related to modulation of CD20 antigen expression occurs in a significant number of patients. It is clear that targeting with either CD19 or CD20 antigen alone is insufficient for a curative therapy. The methods disclosed herein provide for construction and administration of two or more switches with different specificities (e.g., an anti-CD19 antibody CAR-EC switch and an anti-CD20 antibody CAR-EC switch). The methods disclosed herein provide for construction and administration of two or more switches with different specificities (e.g., an anti-CD19 antibody CAR-EC switch and an anti-CD22 antibody CAR-EC switch). This methodology may offer a significant advantage against the propensity for relapse in the clinic while avoiding persistent loss of B cells. A heterogeneous tumor or heterogeneous blood cell malignancy may also be treated with an anti-CD19 antibody CAR-EC switch and an anti-CD22 antibody CAR-EC switch. One or more CAR-EC switches may be administered sequentially or simultaneously. A second switch targeting a second cell surface molecule on the target cell may be administered after down regulation of a first cell surface molecule on the target cell that is targeted by a first switch.

The CAR-EC switch may be administered with one or more additional therapeutic agents. The one or more additional therapeutic agents may be selected from a group consisting of an immunotherapy, a chemotherapy and a steroid. The one or more additional therapeutic agents may be a chemotherapy drug. The chemotherapy drug may be an alkylating agent, an antimetabolite, an anthracycline, a topoisomerase inhibitor, a mitotic inhibitor, a corticosteroid or a differentiating agent. The chemotherapy drug may be selected from actinomycin-D, bleomycin, altretamine, bortezomib, busulfan, carboplatin, capecitabine, carmustine, chlorambucil, cisplatin, cladribine, clofarabine, cyclophosphamide, cytarabine, dacarbazine, daunorubicin, docetaxel, doxorubicin, epirubicin, etoposide, estramustine, floxuridine, fludarabine, fluorouracil, gemcitbine (Gemzar), hydroxyurea, idarubicin, ifosfamide, irinotecan (Camptosar), ixabepilone, L-asparaginase, lomustine, mechlorethamine, melphalan, 6-mercaptopurine, methotrexate, mitomycin-C, paclitaxel (Taxol), pemetrexed, pentostatin, streptozocin, temozolomide, teniposide, thioguanine, thiotepa, topotecan (Hycamtin), vincristine, vinblastine, vinorelbine, retinoids, tretinoin (ATRA or Atralin®), bexarotene (Targretin®) and arsenic trioxide (Arsenox®). The chemotherapy may be administered as a pill to swallow, as an injection into the muscle or fat tissue, intravenously, topically or directly into a body cavity.

The one or more additional therapeutic agents may comprise an angiogenesis inhibitor. The angiogenesis inhibitor may be selected from bevacizumab, itraconazole, carboxyamidotriazole, TNP-470, CM101, IFN alpha, IL-12, platelet factor 4, suramin, SU5416, thrombospondin, a VEGFR antagonist, an angiostatic steroid with heparin, CAR-ECilage-derived angiogenesis inhibitory factor, matrix metalloprotease inhibitors, angiostatin, endostatin, sorafenib, sunitinib, pazopanib, everolimus, 2-methoxyestradiol, tecogalan, tetrathiomolybdate, thalidomide, prolactin, $\alpha v\beta_3$ inhibitor, linomide, tasquinimod, soluble VEGFR-1, soluble NRP-1, angiopoietin 2, vasostatin, calreticulin, TIMP, CDAI, Meth-1, Meth-2, interferon-alpha, interferon-beta, interferon-gamma, CXCL10, IL-4, IL-12, IL-18, prothrombin, antithrombin III fragment, prolactin, VEGI, SPARC, osteopontin, maspin, canstatin, proliferin-related protein and restin.

The one or more additional therapeutic agents may comprise a hormone therapy. The hormone therapy may be selected from an anti-estrogen (e.g., fulvestrant (Faslodex®), tamoxifen, toremifene (Fareston®)); an aromatase inhibitor (e.g., anastrozole (Arimidex®), exemestane (Aromasin®), letrozole (Femara®)); a progestin (e.g., megestrol acetate (Megace®)); an estrogen; an anti-androgen (e.g., bicalutamide (Casodex®), flutamide (Eulexin®), nilutamide (Nilandron®)); a gonadotropin-releasing hormone (GnRH) or luteinizing hormone-releasing hormone (LHRH) agonist or analog (e.g., leuprolide (Lupron®), goserelin (Zoladex®)).

The one or more additional therapeutic agents may comprise a steroid. The steroid may be a corticosteroid. The steroid may be cortisol or a derivative thereof. The steroid may be selected from prednisone, methylprednisolone (Solumedrol®) or dexamethasone.

The CAR-EC switch may be administered with one or more additional therapies. The one or more additional therapies may comprise laser therapy. The one or more additional therapies may comprise radiation therapy. The one or more additional therapies may comprise surgery.

Disclosed herein are platforms, kits and methods for treating a disease or condition in a subject. The subject may be a healthy subject. The subject may be suffering from a disease or condition. The subject may be suffering from more than one disease or condition. The subject may be suffering from chronic lymphocytic leukemia. The subject may be suffering from acute lymphoblastic leukemia. The subject may be an animal. The subject may be a mammal. The mammal may be a human, a chimpanzee, a gorilla, a monkey, a bovine, a horse, a donkey, a mule, a dog, a cat, a pig, a rabbit, a goat, a sheep, a rat, a hamster, a guinea pig or a mouse. The subject may be a bird or a chicken. The subject may be a human. The subject may be a child. The child may be suffering from acute lymphoblastic leukemia. The subject may be less than 6 months old. The subject may be about 1 year old, about 2 years old, about 3 years old, about 4 years old, about 5 years old, about 6 years old, about 7 years old, about 8 years old, about 9 years old, about 10 years old, about 11 years old, about 12 years old, about 13 years old, about 14 years old, about 15 years old, about 18 years old, about 20 years old, about 25 years old, about 30 years old, about 35 years old, about 40 years old, about 45 years old, about 50 years old, about 55 years old, about 60 years old, about 65 years old, about 70 years old, about 75 years old, about 80 years old, about 85 years old, about 90 years old, about 95 years old, about 100 years old or about 105 years old.

In some embodiments, the present disclosure provides a method of treating a disease or condition disclosed herein comprising administering (i) a CAR-EC comprising a humanized CAR disclosed herein and (ii) a complementary humanized CAR-EC switch disclosed herein. In some embodiments, the present disclosure provides a method of treating a disease or condition disclosed herein comprising administering (i) a CAR-EC comprising a CAR having a sequence selected from SEQ ID NOS: 63-92, 104, 115, and 181-183 and (ii) a complementary humanized CAR-EC switch disclosed herein. The switch may comprise a light chain sequence selected from SEQ ID NOS: 17-24 and a CAR-ID disclosed herein. The light chain sequence may comprise a humanized sequence selected from SEQ ID NOS: 27-34. The switch may comprise a heavy chain sequence selected from SEQ ID NOS: 2-14. In some embodiments, the present disclosure provides a method of treating a disease or condition disclosed herein comprising administering (i) a CAR-EC comprising a CAR with an extracellular domain that is a scFv having a sequence selected from any one of SEQ ID NOS: 290-388, and 423 and (ii) a complementary humanized CAR-EC switch disclosed herein. The switch may comprise a light chain sequence selected from SEQ ID NOS: 17-24 and a CAR-ID disclosed herein. The light chain sequence may comprise a humanized sequence selected from SEQ ID NOS: 27-34. The switch may comprise a heavy chain sequence selected from SEQ ID NOS: 2-14. The administration may be in any order. For example, in some embodiments, the CAR-EC cells may be administered prior to CAR-EC switch administration. In some embodiments, the CAR-EC switch may be administered prior to CAR-EC cell administration. In some embodiments, the CAR-EC cells may be administered simultaneously with CAR-EC switch administration. In some embodiments, the disease or condition is a disease or condition in which CD19+ cells are implicated in pathology. In some embodiments, the disease or condition is selected from heterogeneous tumors and blood cell malignancies. In some embodiments, the disease or condition is selected from acute lymphoblastic leukemia and chronic lymphocytic leukemia. In some embodiments, the disease or condition is selected from multiple myeloma, acute myeloid leukemia, Hodgkins lymphoma, Non-hodgkins lymphoma (NHL), Diffuse large B cell lymphoma (DLBCL), Follicular lymphomas, Mantle cell lymphoma (MCL), Burkitt lymphoma, and Hairy cell leykemia (HCL).

IX. Methods of Killing or Activating Target Cells

Further disclosed herein are methods of killing a target cell, comprising contacting a chimeric receptor-effector cell disclosed herein with a chimeric receptor-effector cell switch disclosed herein, wherein the chimeric receptor-effector cell expresses a chimeric receptor with a non-antibody extracellular domain that binds to a CAR-ID on the chimeric receptor effector cell switch, and wherein the chimeric receptor effector cell switch comprises the binding domain that binds the non-antibody extracellular domain of the chimeric receptor and the switch comprises a targeting moiety that binds an antigen on the target cell.

Further disclosed herein are methods of killing a target cell, comprising contacting a CAR-EC disclosed herein with a CAR-EC switch disclosed herein, wherein the CAR-EC expresses a CAR with an extracellular domain that binds to a CAR-ID on the CAR-EC switch, and wherein the CAR-EC switch comprises a CAR– that binds an extracellular domain of the CAR and the switch comprises a targeting moiety that binds an antigen (e.g., a tumor associated antigen) on the target cell.

Further disclosed herein are methods of lysing a target cell, comprising contacting a CAR-EC disclosed herein with a CAR-EC switch disclosed herein, wherein the CAR-EC expresses a CAR with an extracellular domain that binds to a CAR-ID on the CAR-EC switch, and wherein the CAR-EC switch comprises a CAR– that binds an extracellular domain of the CAR and the switch comprises a targeting moiety that binds an antigen (e.g., a tumor associated antigen) on the target cell.

The contacting may occur in vitro. The contacting may occur in vivo in a subject. The subject may be any of the subjects disclosed herein. The subject may have a disease. The disease may be any one or more of the diseases disclosed herein. The disease may be cancer. The contacting may be via administration, via the methods described herein. The administering may comprise administering the CAR-EC switch to a subject that has already been administered chimeric receptor-effector cells expressing a chimeric receptor that binds the switch. The administering may comprise administering to a subject the CAR-EC switch and further administering to the subject a CAR-EC expressing a chimeric receptor that binds the CAR-EC switch.

The contacting may induce lysis of the targeted cell. The contacting may kill the target cell. The contacting may kill target cells with an $EC_{50}$ for killing that ranges from about 1 pM to about 100 pM. The contacting may kill target cells with an $EC_{50}$ for killing that is lower than 1 pM. The contacting may kill a cell that has a disease. The cell may have any disease disclosed herein. The disease may be cancer.

The switch may be any switch disclosed herein. The switch may comprise a K4 peptide fused to, grafted to, or attached to a targeting moiety. The switch may comprise an E4 fused to, grafted to, or attached to a targeting moiety. The switch may comprise a GCN4 peptide fused to, grafted to, or attached to a targeting moiety. The GCN4 peptide may comprise a sequence of Structure I: $X_1$NYHLENEVARLKX$_2$X$_3$ (SEQ ID NO: 269), wherein $X_1$, $X_2$, and $X_3$ are all any amino acid or absent. The GCN4 peptide may comprise a GCN4 derivative disclosed herein (e.g., any one of SEQ ID NOS: 139-153 and 245). The switch may comprise a Flag tag fused to, grafted to, or attached to a targeting moiety. The switch may comprise a FITC attached to a targeting moiety. The targeting moiety may bind CD19. The targeting moiety may be an anti-CD19 antibody, or an antigen binding portion thereof. The targeting moiety may be a humanized anti-CD19 antibody, or an antigen binding portion thereof. The targeting moiety may bind CD20, CD22, EGFR, EGFRvIII, Her2, CS1, BCMA, CEA, CLL1, CD33, or CD123. The targeting moiety may be an anti-CD20 antibody, an anti-CD22 antibody, an anti-EGFR antibody, an anti-EGFRvIII antibody, an anti-Her2 antibody, an anti-CS1 antibody, an anti-BCMA antibody, an anti-CEA antibody, an anti-CLL1 antibody, an anti-CD123 antibody, or an anti-CD33 antibody. The targeting moiety may be a humanized anti-CD20 antibody, a humanized anti-CD22 antibody, a humanized anti-EGFR antibody, a humanized anti-EGFRvIII antibody, a humanized anti-Her2 antibody, a humanized anti-CS1 antibody, a humanized anti-BCMA antibody, a humanized anti-CEA antibody, a humanized anti-CLL1 antibody, a humanized anti-CD123 antibody, or a humanized anti-CD33 antibody.

In some embodiments, the present disclosure provides a method of killing a target cell comprising administering (i) a CAR-EC comprising a humanized CAR disclosed herein and (ii) a complementary humanized CAR-EC switch disclosed herein. In some embodiments, the present disclosure provides a method of killing a target cell comprising administering (i) a CAR-EC comprising a CAR having a sequence selected from SEQ ID NOS: 63-92, 104, 115, and 181-183 and (ii) a complementary humanized CAR-EC switch disclosed herein. The switch may comprise a light chain sequence selected from SEQ ID NOS: 17-24 and a CAR-ID disclosed herein. The light chain sequence may comprise a humanized sequence selected from SEQ ID NOS: 27-34. The switch may comprise a heavy chain sequence selected from SEQ ID NOS: 2-14. In some embodiments, the present disclosure provides a method of killing a target cell comprising administering (i) a CAR-EC comprising a CAR selected from the CARs described in Table 11 or Table 12 or a CAR having a humanized extracellular domain that is a scFv having a sequence selected from any one of SEQ ID NOS: 290-388, and 423 and (ii) a complementary humanized CAR-EC switch disclosed herein. The switch may comprise a light chain sequence selected from SEQ ID NOS: 17-24 and a CAR-ID disclosed herein. The light chain sequence may comprise a humanized sequence selected from SEQ ID NOS: 27-34. The switch may comprise a heavy chain sequence selected from SEQ ID NOS: 2-14.

Further disclosed herein are methods of activating a target cell, comprising contacting a chimeric receptor-effector cell disclosed herein with a chimeric receptor-effector cell switch disclosed herein, wherein the chimeric receptor-effector cell is only activated if the contacting includes both (i) binding of the CAR-ID on the chimeric receptor effector cell switch to the non-antibody extracellular domain of the chimeric receptor expressed on the chimeric receptor-effector cell and (ii) concurrent binding of the targeting moiety on the chimeric receptor effector cell switch to its target antigen.

Further disclosed are methods of lysing a target cell. In some embodiments, the present disclosure provides a method of lysing a target cell comprising administering (i) a CAR-EC comprising a humanized CAR disclosed herein and (ii) a complementary humanized CAR-EC switch disclosed herein. In some embodiments, the present disclosure provides a method of lysing a target cell comprising administering (i) a CAR-EC comprising a CAR having a sequence selected from SEQ ID NOS: 63-92, 104, 115, and 181-183 and (ii) a complementary humanized CAR-EC switch disclosed herein. The switch may comprise a light chain sequence selected from SEQ ID NOS: 17-24 and a CAR-ID disclosed herein. The light chain sequence may comprise a humanized sequence selected from SEQ ID NOS: 27-34. The switch may comprise a heavy chain sequence selected from SEQ ID NOS: 2-14. In some embodiments, the present disclosure provides a method of lysing a target cell comprising administering (i) a CAR-EC comprising a CAR selected from the CARs described in Table 11 or Table 12 or a CAR having a humanized extracellular domain that is a scFv having a sequence selected from any one of SEQ ID NOS: 290-388, and 423 and (ii) a complementary humanized CAR-EC switch disclosed herein. The switch may comprise a light chain sequence selected from SEQ ID NOS: 17-24 and a CAR-ID disclosed herein. The light chain sequence may comprise a humanized sequence selected from SEQ ID NOS: 27-34. The switch may comprise a heavy chain sequence selected from SEQ ID NOS: 2-14.

Further disclosed herein are methods of activating a CAR-EC (e.g., a CAR-EC disclosed herein), comprising contacting the CAR-EC (e.g., the CAR-EC disclosed herein) with a complementary CAR-EC switch disclosed herein, wherein the CAR-EC is activated only if the contacting includes both (i) binding of the CAR-ID on the CAR-EC switch to the extracellular domain of the chimeric receptor (e.g., CAR) expressed on the CAR-EC and (ii) concurrent binding of the targeting moiety on the CAR-EC switch to its target antigen. In some embodiments, the present disclosure provides a method of activating a CAR-EC comprising administering (i) a CAR-EC comprising a humanized CAR disclosed herein and (ii) a complementary humanized CAR-EC switch disclosed herein. In some embodiments, the present disclosure provides a method of activating a CAR-EC comprising administering (i) a CAR-EC comprising a CAR having a sequence selected from SEQ ID NOS: 63-92, 104, 115, and 181-183 and (ii) a complementary humanized CAR-EC switch disclosed herein. The switch may comprise a light chain sequence selected from SEQ ID NOS: 17-24 and a CAR-ID disclosed herein. The light chain sequence may comprise a humanized sequence selected from SEQ ID NOS: 27-34. The switch may comprise a heavy chain sequence selected from SEQ ID NOS: 2-14. In some embodiments, the present disclosure provides a method of killing a target cell comprising administering (i) a CAR-EC comprising a CAR selected from the CARs described in Table 11 or Table 12 or a CAR having a humanized extracellular domain that is a scFv having a sequence selected from any one of SEQ ID NOS: 290-388, and 423 and (ii) a complementary humanized CAR-EC switch disclosed herein. The switch may comprise a light chain sequence selected from SEQ ID NOS: 17-24 and a CAR-ID disclosed herein. The light chain sequence may comprise a humanized sequence selected from SEQ ID NOS: 27-34. The switch may comprise a heavy chain sequence selected from SEQ ID NOS: 2-14.

The contacting may occur in vitro. The contacting may occur in vivo in a subject. The subject may be any of the subjects disclosed herein. The subject may be a human. The subject may have a disease. The disease may be any one or more of the diseases disclosed herein. The disease may be cancer. The contacting may be via administration (or "administering"). The administration may be via any one or more of the methods described herein. The administering may comprise administering the CAR-EC switch to a subject that has already been administered a CAR-EC expressing a chimeric receptor that binds the switch (i.e., a CAR-EC expressing a complementary CAR). The administering may comprise administering to a subject the CAR-EC switch and further administering to the subject a CAR-EC expressing a CAR that binds the CAR-EC switch.

The contacting may induce lysis of the targeted cell. The contacting may kill the target cell. The contacting may kill target cells with an $EC_{50}$ for killing that ranges from about 1 pM to about 100 pM. The contacting may kill target cells with an $EC_{50}$ for killing that is lower than 1 pM. The contacting may kill a cell that has a disease. The cell may have any disease disclosed herein. The disease may be cancer.

The switch may be any switch disclosed herein. The switch may comprise a K4 peptide fused to, grafted to, or attached to a targeting moiety. The switch may comprise an E4 fused to, grafted to, or attached to a targeting moiety. The switch may comprise a GCN4 peptide fused to, grafted to, or attached to a targeting moiety. The GCN4 peptide may comprise a sequence of Structure I: $X_1$NYHLENEVARLKX$_2$X$_3$ (SEQ ID NO: 269), wherein $X_1$, $X_2$, and $X_3$ are all any amino acid or absent. The GCN4 peptide may comprise a GCN4 derivative disclosed herein (e.g., any one of SEQ ID NOS: 139-153 and 245). The switch may comprise a Flag tag fused to, grafted to, or attached to a targeting moiety. The switch may comprise a FITC attached to a targeting moiety. The targeting moiety may bind CD19. The targeting moiety may be a humanized anti-CD19 antibody, or an antigen binding portion thereof.

The CAR-EC switch may comprise a targeting moiety that is an FMC63 antibody, or a CD19-binding portion thereof, which comprises (i) a light chain sequence selected from the group consisting of SEQ ID NOS: 16-25 and (ii) a heavy chain sequence selected from the group consisting of SEQ ID NOS: 1-15. The CAR-EC switch may comprise a a GCN4 peptide fused to a targeting moiety that is an FMC63 antibody, or a CD19-binding portion thereof, which comprises (i) a light chain sequence selected from the group consisting of SEQ ID NOS: 16-25 and (ii) a heavy chain sequence selected from the group consisting of SEQ ID NOS: 1-15, wherein the GCN4 peptide comprises a sequence of Structure I: X1NYHLENEVARLKX2X3 (SEQ ID NO: 269), wherein X1, X2, and X3 are all any amino acid or absent. The GCN4 peptide may comprise a GCN4 derivative disclosed herein. The GCN4 peptide may be selected from any one of SEQ ID NOS: 139-153 and 245).

X. CAR-EC Platform

Disclosed herein are humanized chimeric antigen receptor effector cell (CAR-EC) platforms comprising (i) an effector cell, wherein the effector cell comprises a polynucleotide encoding a chimeric antigen receptor (CAR); and (ii) a chimeric antigen receptor effector cell (CAR-EC) switch, wherein the CAR-EC switch comprises a CAR-ID and a targeting moiety and wherein the CAR-EC switch binds a cell surface molecule on a target cell, and wherein one or both of the CAR and the CAR-EC switch are humanized. Also disclosed herein are humanized CAR-EC platforms comprising (i) an effector cell, wherein the effector cell expresses a CAR; and (ii) a CAR-EC switch, wherein the CAR-EC switch comprises a CAR-ID and a targeting moiety and wherein the targeting moiety of the CAR-EC switch binds a cell surface molecule on a target cell, and wherein one or both of the CAR and the CAR-EC switch are humanized. The CAR-EC switch may be selected from any CAR-EC switches disclosed herein (e.g., a humanized CAR-EC switch disclosed here). As used herein, the terms "switchable CAR platform", "CAR-EC platform", "sCAR-T platform", "sCAR-T cell platform", "switchable chimeric antigen receptor platform", "chimeric antigen receptor-effector cell platform", "CAR-T switch platform", "sCAR platform", "switch platform", and "switchable platform" are used interchangeably.

The CAR-EC platform may comprise a first CAR-EC switch. The CAR-EC platform a first CAR-EC switch and at least one second CAR-EC switch. In some embodiments, the CAR-EC platform comprises at least two humanized CAR-EC switches. The CAR-EC platforms may comprise 3, 4, 5, 6, 7, 8, 9, 10, 11, 12, 13, 14, 15, 16, 17, 18, 19, 20 or more humanized CAR-EC switches. The CAR-EC platforms may comprise may comprise more than 20, more than 25, more than 30, more than 35, more than 40, more than 45 or more than 50 humanized CAR-EC switches. The two or more switches may be selected from one or more humanized CAR-EC switches disclosed herein or a combination thereof.

The CAR-EC platforms disclosed herein may further comprise a first CAR-EC switch and a second CAR-EC switch, wherein the first CAR-EC switch comprises a first CAR-ID and a first targeting moiety and the second CAR-EC switch comprises a second CAR-ID and a second targeting moiety. The first CAR-ID and the second CAR-ID may be the same. The first CAR-ID and the second CAR-ID may be different. The first CAR-ID and the second CAR-ID may be about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical. The first targeting moiety and the second targeting moiety may be the same. The first targeting moiety and the second targeting moiety may be different. The first targeting moiety and the second targeting moiety may be about 99%, about 98%, about 97%, about 96%, about 95%, about 92%, about 90%, about 85%, about 80%, about 75%, about 70%, about 65%, about 60%, about 55%, about 50%, about 45%, about 40%, about 35%, about 30%, about 25%, about 20%, about 15%, about 10%, about 5% or about 2% identical.

The CAR-EC switch may have any switch sequence disclosed herein. For example, it may comprise a light chain and a heavy chain, wherein the light chain comprises or consists of any switch light chain sequence disclosed herein and the heavy chain comprises or consists of any switch heavy chain sequence disclosed herein. Such heavy and/or light chain sequences may be humanized. In some embodiments, the CAR-EC switch is humanized and comprises a light chain sequence selected from SEQ ID NOS: 17-24 and a heavy chain sequence selected from SEQ ID NOS: 2-14, wherein one or both of the heavy and light chains comprise a CAR-ID disclosed herein (e.g., a GCN4 CAR-ID). In particular embodiments, the light chain sequence comprises a humanized sequence selected from SEQ ID NOS: 27-34 (which comprise an N-terminal GCN4 CAR-ID) and a heavy chain sequence selected from SEQ ID NOS: 2-14. In particular embodiments, the switch is a switch described in Table 6 or Table 8, which presents heavy chain/light chain combinations comprised in several of the switches disclosed herein. In some embodiments, the switch is identical to a switch described in Table 6 or Table 8, except that the CAR-ID comprised in the switch is modified to have a sequence of Structure I. In some embodiments, the sequence of Structure I is selected from any one of SEQ ID NOS: 26, 36, 139-163, and 245.

The CAR-EC platforms disclosed herein may further comprise a first CAR-EC. The first CAR-EC may comprise a first CAR. The first CAR may be humanized. The first CAR may be a CAR disclosed herein. The first CAR may have any CAR sequence disclosed herein. The first CAR may be humanized to reduce immunogenicity to humans. The first CAR may comprise an extracellular domain that is humanized. The humanization may reduce immunogenicity of the CAR to humans while retaining the specificity and affinity of the extracellular domain for the CAR-EC switch. The first CAR may be a humanized version of any one of the CAR sequences provided in Table 13 or it may be a humanized version of any one of SEQ ID NOS: 270-289. The first CAR may be a humanized CAR comprising an extracellular domain that comprises an antibody or antibody fragment that binds to a CAR-ID of a CAR-EC switch. The antibody or antibody fragment may be humanized. The antibody fragment may be a scFv (e.g., a humanized scFv). The scFv or humanized scFv may comprise or consist of the general structure light chain-linker-heavy chain. The scFv or humanized scFv may comprise or consist of the general structure heavy chain-linker-light chain. The humanized scFv may comprise a humanized VH (variable heavy chain) sequence with non-human (e.g., murine) CDRs transplanted onto a human immunoglobulin framework. The humanized scFv may comprise a humanized VL (variable light chain) sequence with non-human (e.g., murine) CDRs transplanted onto a human immunoglobulin framework. In some particular embodiments, the first CAR comprises a structure selected from constructs A-H in FIG. 24A. In certain embodiments, the first CAR comprises a structure according to construct A, construct B, or construct C in FIG. 24. In certain embodiments, the first CAR is selected from the CARs described in Table 11. In certain particular embodiments, the first CAR is selected from the CARs described in Table 12. In certain embodiments, the extracellular domain of the first CAR comprises a humanized scFv sequence selected from any one of SEQ ID NOS: 290-388, and 423.

In certain embodiments, the CAR-EC platform comprises
  a. a first CAR-EC switch:
    i. that comprises a humanized light chain sequence selected from SEQ ID NOS: 27-34 (which comprise an N-terminal GCN4 CAR-ID) and a heavy chain sequence selected from SEQ ID NOS: 2-14;
    ii. as described in Table 6 or Table 8, which presents heavy chain/light chain combinations comprised in several of the switches disclosed herein; or
    iii. that is identical to a switch described in Table 6 or Table 8, except that the CAR-ID comprised in the switch is modified to have a sequence selected from any one of SEQ ID NOS: 26, 36, 139, and 154-163; and b. and a first CAR-EC expressing a complementary first CAR; wherein the CAR
   i. comprises a structure selected from constructs A-H in FIG. 24A;
   ii. comprises a structure according to construct E in FIG. 24A;
   iii. is selected from the CARs described in Table 11;
   iv. is selected from the CARs described in Table 12; or
   v. extracellular domain comprises a humanized scFv sequence selected from any one of SEQ ID NOS: 290-388, and 423;

and optionally c. one or more second CAR-EC switch, at least one of which comprises a different targeting moiety that binds a different target than the targeting moiety on the first CAR-EC switch; and wherein the CAR-ID on each second CAR-EC switch is optionally the same or different than the CAR-ID on the first CAR-EC switch;

wherein in some embodiments, when CAR-ID on the first switch is different than the CAR-ID on the second switch, and the first CAR cannot bind to the second CAR-ID, the platform may also comprise a second CAR-EC that binds the CAR-ID on the second switch.

TABLE 3

SEQUENCES
Sequence Table

| Sequence | Seq id no | Name | ID |
| --- | --- | --- | --- |
| QVQLQESGPGLVKPSETLSLTCTVSGGSISSYYWSWIRQPP GKGLEWIGYIYYSGSTNYNPSLKSRVTISVDTSKNQFSLKL SSVTAADTAVYYCAR | 1 | h4-59_01 | Amino acid |
| QVQLQESGPGLVKPSETLSLTCTVSGVSLPDYGVSWIRQPP GKGLEWIGVIWGSETTYYNPSLKSRVTISVDTSKNQFSLKL SSVTAADTAVYYCARHYYYGGSYAMDYWGQGTLVTVSS | 2 | hFMCH1 | Amino acid |
| QVQLQESGPGLVKPSETLSVTCTVSGVSLPDYGVSWIRQPP GKGLEWLGVIWGSETTYYNPSLKSRLTISKDTSKNQVSLKM SSLTAADTAVYYCARHYYYGGSYAMDYWGQGTLVTVSS | 3 | hFMCH2 | Amino acid |
| QVQLQESGPGLVKPSETLSVTCTVSGVSLPDYGVSWIRQPP GKGLEWLGVIWGSETTYYNPSLKSRLTISKDNSKNQVSLKM SSLTAADTAVYYCARHYYYGGSYAMDYWGQGTLVTVSS | 4 | hFMCH3 | Amino acid |
| QVQLQESGPGLVKPSETLSVTCTVSGVSLPDYGVSWIRQPP GKGLEWLGVIWGSETTYYNPSLKSRLTISKDTSKNQVSLKM SSLTAADTAVYYCAKHYYYGGSYAMDYWGQGTLVTVSS | 5 | hFMCH4a | Amino acid |
| QVQLQESGPGLVKPSETLSVTCTVSGVSLPDYGVSWIRQPP GKGLEWLGVIWGSETTYYNPSLKSRLTISKDNSKNQVSLKM SSLTAADTAVYYCAKHYYYGGSYAMDYWGQGTLVTVSS | 6 | hFMCH4b | Amino acid |
| QVQLQESGPGLVKPSETLSVTCTVSGVSLPDYGVSWIRQPP GKGLEWLGVIWGSETTYYNSALKSRLTISKDNSKNQVSLKM SSLTAADTAVYYCAKHYYYGGSYAMDYWGQGTLVTVSS | 7 | hFMCH4c | Amino acid |
| QVQLQESGPGLVKPSETLSVTCTVSGVSLPDYGVSWIRQPP GKGLEWLGVIWGSETTYYNSSLKSRLTISKDNSKNQVSLKM SSLTAADTAVYYCAKHYYYGGSYAMDYWGQGTLVTVSS | 8 | hFMCH4z | Amino acid |
| QVQLQESGPGLVKPSETLSLTCTVSGVSLPDYGVSWIRQPP GKGLEWIGVIWGSETTYYNPSLKSRVTISKDNSKNQFSLKL SSVTAADTAVYYCAKHYYYGGSYAMDYWGQGTLVTVSS | 9 | hFMCH4b-x | Amino acid |
| QVQLQESGPGLVKPSETLSLTCTVSGVSLPDYGVSWIRQPP GKGLEWIGVIWGSETTYYNSALKSRVTISKDNSKNQFSLKL SSVTAADTAVYYCAKHYYYGGSYAMDYWGQGTLVTVSS | 10 | hFMCH4c-x | Amino acid |
| EVQLQESGPGLVKPSETLSLTCTVSGVSLPDYGVSWIRQPP GKGLEWLGVIWGSETTYYNSALKSRLTISKDNSKNQVSLKM SSLTAADTAVYYCAKHYYYGGSYAMDYWGQGTLVTVSS | 11 | hFMCH4c-20L-E | Amino acid |
| EVQLQESGPGLVKPSETLSVTCTVSGVSLPDYGVSWIRQPP GKGLEWLGVIWGSETTYYNPSLKSRLTISKDNSKNQVSLKM SSLTAADTAVYYCAKHYYYGGSYAMDYWGQGTLVTVSS | 12 | hFMCH4b-E | Amino acid |
| EVQLQESGPGLVKPSETLSVTCTVSGVSLPDYGVSWIRQPP GKGLEWLGVIWGSETTYYNSALKSRLTISKDNSKNQVSLKM SSLTAADTAVYYCAKHYYYGGSYAMDYWGQGTLVTVSS | 13 | hFMCH4c-E | Amino acid |
| EVQLQESGPGLVKPSETLSLTCTVSGVSLPDYGVSWIRQPP GKGLEWLGVIWGSETTYYNPSLKSRLTISKDNSKNQVSLKM SSLTAADTAVYYCAKHYYYGGSYAMDYWGQGTLVTVSS | 14 | hFMCH4b-20L-E | Amino acid |

TABLE 3-continued

SEQUENCES
Sequence Table

| Sequence | Seq id no | Name | ID |
|---|---|---|---|
| EVKLQESGPGLVAPSQSLSVTCTVSGVSLPDYGVSWIRQPP RKGLEWLGVIWGSETTYYNSALKSRLTIIKDNSKSQVFLKM NSLQTDDTAIYYCAKHYYYGGSYAMDYWGQGTSVTVSS | 15 | mFMC63H | Amino acid |
| DIQMTQSPSSLSASVGDRVTITCRASQSISSYLNWYQQKPG KAPKLLIYAASSLQSGVPSRFSGSGSGTDFTLTISSLQPED FATYYCQQSYSTPP | 16 | IGKV1-39 | Amino acid |
| DIQMTQSPSSLSASVGDRVTITCRASQDISKYLNWYQQKPG KAPKLLIYHTSRLHSGVPSRFSGSGSGTDFTLTISSLQPED FATYYCQQGNTLPYTFGQGTKLEIK | 17 | hFMCL1 | Amino acid |
| DIQMTQSPSSLSASVGDRVTITCRASQDISKYLNWYQQKPG KAPKLLIYHTSRLHSGVPSRFSGSGSGTDYTLTISSLQPED FATYYCQQGATLPYTFGQGTKLEIK | 18 | hFMCL2 | Amino acid |
| DIQMTQSPSSLSASVGDRVTITCRASQDISKYLNWYQQKPG KAVKLLIYHTSRLHSGVPSRFSGSGSGTDYTLTISSLQPED FATYYCQQGATLPYTFGQGTKLEIK | 19 | hFMCL2a | Amino acid |
| DIQMTQSPSSLSASVGDRVTITCRASQDISKYLNWYQQKPG KAVKLLIYHTSRLHSGVPSRFSGSGSGTDYTLTISSLQPED FATYFCQQGATLPYTFGQGTKLEIK | 20 | hFMCL2b | Amino acid |
| DIQMTQSPSSLSASVGDRVTITCRASQDISKYLNWYQQKPG KAPKLLIYHTSRLHSGVPSRFSGSGSGTDYTLTISSLQPED FATYFCQQGATLPYTFGQGTKLEIK | 21 | hFMCL2b-1 | Amino acid |
| DIQMTQSPSSLSASVGDRVTITCRASQDISKYLNWYQQKPG KALKLLIYHTSRLHSGVPSRFSGSGSGTDYTLTISSLQPED FATYFCQQGATLPYTFGQGTKLEIK | 22 | hFMCL2b(V44L) | Amino acid |
| DIQMTQSPSSLSASVGDRVTITCRASQDISKYLNWYQQKPG KAVKLLIYHTSRLHSGVPSRFSGSGSGTDYTLTISSLQPED FATYFCQQGNTLPYTFGQGTKLEIK | 23 | hFMCL2b(A92N) | Amino acid |
| DIQMTQSPSSLSASVGDRVTITCRASQDISKYLNWYQQKPG KAIKLLIYHTSRLHSGVPSRFSGSGSGTDYTLTISSLQPED FATYFCQQGATLPYTFGQGTKLEIK | 24 | hFMCL2c | Amino acid |
| DIQMTQTTSSLSASLGDRVTISCRASQDISKYLNWYQQKPD GTVKLLIYHTSRLHSGVPSRFSGSGSGTDYSLTISNLEQED IATYFCQQGNTLPYTFGGGTKLEIK | 25 | mFMC63L | Amino acid |
| NYHLENEVARLKKL | 26 | yeast transcription factor GCN4 truncated binding peptide | Amino acid |
| NYHLENEVARLKKLGGGGSDIQMTQSPSSLSASVGDRVTIT CRASQDISKYLNWYQQKPGKAPKLLIYHTSRLHSGVPSRFS GSGSGTDFTLTISSLQPEDFATYYCQQGNTLPYTFGQGTKL EIK | 27 | hFMCL1-LCNT | Amino acid |
| NYHLENEVARLKKLGGGGSDIQMTQSPSSLSASVGDRVTIT CRASQDISKYLNWYQQKPGKAPKLLIYHTSRLHSGVPSRFS GSGSGTDYTLTISSLQPEDFATYYCQQGATLPYTFGQGTKL EIK | 28 | hFMCL2-LCNT | Amino acid |
| NYHLENEVARLKKLGGGGSDIQMTQSPSSLSASVGDRVTIT CRASQDISKYLNWYQQKPGKAVKLLIYHTSRLHSGVPSRFS GSGSGTDYTLTISSLQPEDFATYYCQQGATLPYTFGQGTKL EIK | 29 | hFMCL2a-LCNT | Amino acid |
| NYHLENEVARLKKLGGGGSDIQMTQSPSSLSASVGDRVTIT CRASQDISKYLNWYQQKPGKAVKLLIYHTSRLHSGVPSRFS GSGSGTDYTLTISSLQPEDFATYFCQQGATLPYTFGQGTKL EIK | 30 | hFMCL2b-LCNT | Amino acid |

TABLE 3-continued

SEQUENCES
Sequence Table

| Sequence | Seq id no | Name | ID |
|---|---|---|---|
| NYHLENEVARLKKLGGGGSDIQMTQSPSSLSASVGDRVTIT CRASQDISKYLNWYQQKPGKAPKLLIYHTSRLHSGVPSRFS GSGSGTDYTLTISSLQPEDFATYFCQQGATLPYTFGQGTKL EIK | 31 | hFMCL2b-1-LCNT | Amino acid |
| NYHLENEVARLKKLGGGGSDIQMTQSPSSLSASVGDRVTIT CRASQDISKYLNWYQQKPGKALKLLIYHTSRLHSGVPSRFS GSGSGTDYTLTISSLQPEDFATYFCQQGATLPYTFGQGTKL EIK | 32 | hFMCL2b(V44L)-LCNT | Amino acid |
| NYHLENEVARLKKLGGGGSDIQMTQSPSSLSASVGDRVTIT CRASQDISKYLNWYQQKPGKAVKLLIYHTSRLHSGVPSRFS GSGSGTDYTLTISSLQPEDFATYFCQQGNTLPYTFGQGTKL EIK | 33 | hFMCL2b(A92N)-LCNT | Amino acid |
| NYHLENEVARLKKLGGGGSDIQMTQSPSSLSASVGDRVTIT CRASQDISKYLNWYQQKPGKAVKLLIYHTSRLHSGVPSRFS GSGSGTDYTLTISSLQPEDFATYFCQQGATLPYTFGQGTKL EIK | 34 | hFMCL2c-LCNT | Amino acid |
| NYHLENEVARLKKLGGGGSDIQMTQTTSSLSASLGDRVTIS CRASQDISKYLNWYQQKPDGTVKLLIYHTSRLHSGVPSRFS GSGSGTDYSLTISNLEQEDIATYFCQQGNTLPYTFGGGTKL EIK | 35 | mFMC63-LCNT | Amino acid |
| RMKQLEPKVEELLPKNYHLENEVARLKKLVGER | 36 | yeast transcription factor GCN4 (7P14P) | Amino acid |
| GGGGSNYHLENEVARLKKLGGGGS | 37 | yeast transcription factor GCN4 truncated binding peptide with linkers | Amino acid |
| GGGGSDYKDDDDK | 38 | Hydrophilic target peptide (HTP) | Amino acid |
| GGGGSDYKDDDDKP | 39 | Hydrophilic target peptide (HTP) P | Amino acid |
| DYKDDDDK | 40 | FLAG ® | Amino acid |
| CAGGTGGCACTTTTCGGGGAAATGTGCGCGGAACCCCTATT TGTTTATTTTTCTAAATACATTCAAATATGTATCCGCTCAT GAGACAATAACCCTGATAAATGCTTCAATAATATTGAAAAA GGAAGAGTATGAGTATTCAACATTTCCGTGTCGCCCTTATT CCCTTTTTTGCGGCATTTTGCCTTCCTGTTTTTGCTCACCC AGAAACGCTGGTGAAAGTAAAAGATGCTGAAGATCAGTTGG GTGCACGAGTGGGTTACATCGAACTGGATCTCAACAGCGGT AAGATCCTTGAGAGTTTTCGCCCCGAAGAACGTTTTCCAAT GATGAGCACTTTTAAAGTTCTGCTATGTGGCGCGGTATTAT CCCGTATTGACGCCGGGCAAGAGCAACTCGGTCGCCGCATA CACTATTCTCAGAATGACTTGGTTGAGTACTCACCAGTCAC AGAAAAGCATCTTACGGATGGCATGACAGTAAGAGAATTAT GCAGTGCTGCCATAACCATGAGTGATAACACTGCGGCCAAC TTACTTCTGACAACGATCGGAGGACCGAAGGAGCTAACCGC TTTTTTGCACAACATGGGGGATCATGTAACTCGCCTTGATC GTTGGGAACCGGAGCTGAATGAAGCCATACCAAACGACGAG CGTGACACCACGATGCCTGTAGCAATGGCAACAACGTTGCG CAAACTATTAACTGGCGAACTACTTACTCTAGCTTCCCGGC AACAATTAATAGACTGGATGGAGGCGGATAAAGTTGCAGGA | 63 | LV-EF1a-GCN4(52SR4)-BBZ | DNA |

TABLE 3-continued

SEQUENCES
Sequence Table

| Sequence | Seq id no | Name | ID |
|---|---|---|---|
| CCACTTCTGCGCTCGGCCCTTCCGGCTGGCTGGTTTATTGC | | | |
| TGATAAATCTGGAGCCGGTGAGCGTGGGTCTCGCGGTATCA | | | |
| TTGCAGCACTGGGGCCAGATGGTAAGCCCTCCCGTATCGTA | | | |
| GTTATCTACACGACGGGGAGTCAGGCAACTATGGATGAACG | | | |
| AAATAGACAGATCGCTGAGATAGGTGCCTCACTGATTAAGC | | | |
| ATTGGTAACTGTCAGACCAAGTTTACTCATATATACTTTAG | | | |
| ATTGATTTAAAACTTCATTTTTAATTTAAAAGGATCTAGGT | | | |
| GAAGATCCTTTTTGATAATCTCATGACCAAAATCCCTTAAC | | | |
| GTGAGTTTTCGTTCCACTGAGCGTCAGACCCCGTAGAAAAG | | | |
| ATCAAAGGATCTTCTTGAGATCCTTTTTTTCTGCGCGTAAT | | | |
| CTGCTGCTTGCAAACAAAAAAACCACCGCTACCAGCGGTGG | | | |
| TTTGTTTGCCGGATCAAGAGCTACCAACTCTTTTTCCGAAG | | | |
| GTAACTGGCTTCAGCAGAGCGCAGATACCAAATACTGTCCT | | | |
| TCTAGTGTAGCCGTAGTTAGGCCACCACTTCAAGAACTCTG | | | |
| TAGCACCGCCTACATACCTCGCTCTGCTAATCCTGTTACCA | | | |
| GTGGCTGCTGCCAGTGGCGATAAGTCGTGTCTTACCGGGTT | | | |
| GGACTCAAGACGATAGTTACCGGATAAGGCGCAGCGGTCGG | | | |
| GCTGAACGGGGGGTTCGTGCACACAGCCCAGCTTGGAGCGA | | | |
| ACGACCTACACCGAACTGAGATACCTACAGCGTGAGCTATG | | | |
| AGAAAGCGCCACGCTTCCCGAAGGGAGAAAGGCGGACAGGT | | | |
| ATCCGGTAAGCGGCAGGGTCGGAACAGGAGAGCGCACGAGG | | | |
| GAGCTTCCAGGGGGAAACGCCTGGTATCTTTATAGTCCTGT | | | |
| CGGGTTTCGCCACCTCTGACTTGAGCGTCGATTTTTGTGAT | | | |
| GCTCGTCAGGGGGGCGGAGCCTATGGAAAAACGCCAGCAAC | | | |
| GCGGCCTTTTTACGGTTCCTGGCCTTTTGCTGGCCTTTTGC | | | |
| TCACATGTTCTTTCCTGCGTTATCCCCTGATTCTGTGGATA | | | |
| ACCGTATTACCGCCTTTGAGTGAGCTGATACCGCTCGCCGC | | | |
| AGCCGAACGACCGAGCGCAGCGAGTCAGTGAGCGAGGAAGC | | | |
| GGAAGAGCGCCCAATACGCAAACCGCCTCTCCCCGCGCGTT | | | |
| GGCCGATTCATTAATGCAGCTGGCACGACAGGTTTCCCGAC | | | |
| TGGAAAGCGGGCAGTGAGCGCAACGCAATTAATGTGAGTTA | | | |
| GCTCACTCATTAGGCACCCCAGGCTTTACACTTTATGCTTC | | | |
| CGGCTCGTATGTTGTGTGGAATTGTGAGCGGATAACAATTT | | | |
| CACACAGGAAACAGCTATGACCATGATTACGCCAAGCGCGC | | | |
| AATTAACCCTCACTAAAGGGAACAAAAGCTGGAGCTGCAAG | | | |
| CTTAATGTAGTCTTATGCAATACTCTTGTAGTCTTGCAACA | | | |
| TGGTAACGATGAGTTAGCAACATGCCTTACAAGGAGAGAAA | | | |
| AAGCACCGTGCATGCCGATTGGTGGAAGTAAGGTGGTACGA | | | |
| TCGTGCCTTATTAGGAAGGCAACAGACGGGTCTGACATGGA | | | |
| TTGGACGAACCACTGAATTGCCGCATTGCAGAGATATTGTA | | | |
| TTTAAGTGCCTAGCTCGATACAATAAACGGGTCTCTCTGGT | | | |
| TAGACCAGATCTGAGCCTGGGAGCTCTCTGGCTAACTAGGG | | | |
| AACCCACTGCTTAAGCCTCAATAAAGCTTGCCTTGAGTGCT | | | |
| TCAAGTAGTGTGTGCCCGTCTGTTGTGTGACTCTGGTAACT | | | |
| AGAGATCCCTCAGACCCTTTTAGTCAGTGTGGAAAATCTCT | | | |
| AGCAGTGGCGCCCGAACAGGGACCTGAAAGCGAAAGGGAAA | | | |
| CCAGAGCTCTCTCGACGCAGGACTCGGCTTGCTGAAGCGCG | | | |
| CACGGCAAGAGGCGAGGGGCGGCGACTGGTGAGTACGCCAA | | | |
| AAATTTTGACTAGCGGAGGCTAGAAGGAGAGAGATGGGTGC | | | |
| GAGAGCGTCAGTATTAAGCGGGGGAGAATTAGATCGCGATG | | | |
| GGAAAAAATTCGGTTAAGGCCAGGGGAAAGAAAAAATATA | | | |
| AATTAAAACATATAGTATGGGCAAGCAGGGAGCTAGAACGA | | | |
| TTCGCAGTTAATCCTGGCCTGTTAGAAACATCAGAAGGCTG | | | |
| TAGACAAATACTGGGACAGCTACAACCATCCCTTCAGACAG | | | |
| GATCAGAAGAACTTAGATCATTATATAATACAGTAGCAACC | | | |
| CTCTATTGTGTGCATCAAAGGATAGAGATAAAAGACACCAA | | | |
| GGAAGCTTTAGACAAGATAGGAAGAGCAAAACAAAAGTA | | | |
| AGACCACCGCACAGCAAGCGGCCGCTGATCTTCAGACCTGG | | | |
| AGGAGGAGATATGAGGGACAATTGGAGAAGTGAATTATATA | | | |
| AATATAAAGTAGTAAAAATTGAACCATTAGGAGTAGCACCC | | | |
| ACCAAGGCAAAGAGAAGAGTGGTGCAGAGAGAAAAAGAGC | | | |
| AGTGGGAATAGGAGCTTTGTTCCTTGGGTTCTTGGGAGCAG | | | |
| CAGGAAGCACTATGGGCGCAGCCTCAATGACGCTGACGGTA | | | |
| CAGGCCAGACAATTATTGTCTGGTATAGTGCAGCAGCAGAA | | | |
| CAATTTGCTGAGGGCTATTGAGGCGCAACAGCATCTGTTGC | | | |
| AACTCACAGTCTGGGGCATCAAGCAGCTCCAGGCAAGAATC | | | |
| CTGGCTGTGGAAAGATACCTAAAGGATCAACAGCTCCTGGG | | | |
| GATTTGGGGTTGCTCTGGAAAACTCATTTGCACCACTGCTG | | | |
| TGCCTTGGAATGCTAGTTGGAGTAATAAATCTCTGGAACAG | | | |
| ATTGGAATCACACGACCTGGATGGAGTGGGACAGAGAAATT | | | |
| AACAATTACACAAGCTTAATACACTCCTTAATTGAAGAATC | | | |
| GCAAAACCAGCAAGAAAAGAATGAACAAGAATTATTGGAAT | | | |
| TAGATAAATGGGCAAGTTTGTGGAATTGGTTTAACATAACA | | | |
| AATTGGCTGTGGTATATAAAATTATTCATAATGATAGTAGG | | | |

TABLE 3-continued

SEQUENCES
Sequence Table

| Sequence | Seq id no | Name | ID |
|---|---|---|---|
| AGGCTTGGTAGGTTTAAGAATAGTTTTTGCTGTACTTTCTA | | | |
| TAGTGAATAGAGTTAGGCAGGGATATTCACCATTATCGTTT | | | |
| CAGACCCACCTCCCAACCCCGAGGGGACCCGACAGGCCCGA | | | |
| AGGAATAGAAGAAGAAGGTGGAGAGAGAGACAGAGACAGAT | | | |
| CCATTCGATTAGTGAACGGATCTCGACGGTTAACTTTTAAA | | | |
| AGAAAAGGGGGATTGGGGGGTACAGTGCAGGGGAAAGAAT | | | |
| AGTAGACATAATAGCAACAGACATACAAACTAAAGAATTAC | | | |
| AAAAACAAATTACAAAAATTCAAAATTTTATCGAGCTTTGC | | | |
| AAAGATGGATAAAGTTTTAAACAGAGAGGAATCTTTGCAGC | | | |
| TAATGGACCTTCTAGGTCTTGAAAGGAGTGCCTCGTGAGGC | | | |
| TCCGGTGCCCGTCAGTGGGCAGAGCGCACATCGCCCACAGT | | | |
| CCCCGAGAAGTTGGGGGGAGGGGTCGGCAATTGAACCGGTG | | | |
| CCTAGAGAAGGTGGCGCGGGGTAAACTGGGAAAGTGATGTC | | | |
| GTGTACTGGCTCCGCCTTTTTCCCGAGGGTGGGGGAGAACC | | | |
| GTATATAAGTGCAGTAGTCGCCGTGAACGTTCTTTTTCGCA | | | |
| ACGGGTTTGCCGCCAGAACACAGGTAAGTGCCGTGTGTGGT | | | |
| TCCCGCGGGCCTGGCCTCTTTACGGGTTATGGCCCTTGCGT | | | |
| GCCTTGAATTACTTCCACCTGGCTGCAGTACGTGATTCTTG | | | |
| ATCCCGAGCTTCGGGTTGGAAGTGGGTGGGAGAGTTCGAGG | | | |
| CCTTGCGCTTAAGGAGCCCCTTCGCCTCGTGCTTGAGTTGA | | | |
| GGCCTGGCCTGGGCGCTGGGGCCGCCGCGTGCGAATCTGGT | | | |
| GGCACCTTCGCGCCTGTCTCGCTGCTTTCGATAAGTCTCTA | | | |
| GCCATTTAAAATTTTTGATGACCTGCTGCGACGCTTTTTTT | | | |
| CTGGCAAGATAGTCTTGTAAATGCGGGCCAAGATCTGCACA | | | |
| CTGGTATTTCGGTTTTTGGGGCCGCGGGCGGCGACGGGGCC | | | |
| CGTGCGTCCCAGCGCACATGTTCGGCGAGGCGGGGCCTGCG | | | |
| AGCGCGGCCACCGAGAATCGGACGGGGGTAGTCTCAAGCTG | | | |
| GCCGGCCTGCTCTGGTGCCTGGCCTCGCGCCGCCGTGTATC | | | |
| GCCCCGCCCTGGGCGGCAAGGCTGGCCCGGTCGGCACCAGT | | | |
| TGCGTGAGCGGAAAGATGGCCGCTTCCCGGCCCTGCTGCAG | | | |
| GGAGCTCAAAATGGAGGACGCGGCGCTCGGGAGAGCGGGCG | | | |
| GGTGAGTCACCCACACAAAGGAAAAGGGCCTTTCCGTCCTC | | | |
| AGCCGTCGCTTCATGTGACTCCACGGAGTACCGGGCGCCGT | | | |
| CCAGGCACCTCGATTAGTTCTCGAGCTTTTGGAGTACGTCG | | | |
| TCTTTAGGTTGGGGGGAGGGGTTTTATGCGATGGAGTTTCC | | | |
| CCACACTGAGTGGGTGGAGACTGAAGTTAGGCCAGCTTGGC | | | |
| ACTTGATGTAATTCTCCTTGGAATTTGCCCTTTTTGAGTTT | | | |
| GGATCTTGGTTCATTCTCAAGCCTCAGACAGTGGTTCAAAG | | | |
| TTTTTTTCTTCCATTTCAGGTGTCGTGAGGAATTCGGTACC | | | |
| GCGGCCGCCCGGGGATCCATGGCCTTACCAGTGACCGCCTT | | | |
| GCTCCTGCCGCTGGCCTTGCTGCTCCACGCCGCCAGGCCGG | | | |
| ACGCCGTTGTGACCCAGGAATCCGCTCTGACCTCTTCTCCA | | | |
| GGCGAAACCGTGACTCTGACTTGCCGTAGTAGCACCGGGGC | | | |
| TGTGACCACATCTAACTATGCCAGTTGGGTCCAGGAAAAAC | | | |
| CGGATCACCTGTTTACTGGCCTGATTGGCGGCACCAACAAT | | | |
| CGCGCACCGGGTGTGCCCGCTCGTTTCAGCGGTTCCCTGAT | | | |
| TGGGGACAAGGCAGCACTGACTATCACCGGCGCCCAGACCG | | | |
| AAGATGAGGCGATCTATTTTTGCGTCCTGTGGTACAGCGAC | | | |
| CATTGGGTGTTCGGGGGAGGCACCAAACTGACAGTGCTGGG | | | |
| CGGAGGAGGAGGTTCAGGAGGAGGAGGTAGCGGGGGAGGCG | | | |
| GTTCCGGGGGAGGCGGTTCTGATGTGCAGCTGCAAGAATCC | | | |
| GGGCCAGGACTGGTTGCGCCTTCTCAGAGTCTGTCAATTAC | | | |
| ATGTACTGTTAGTGGCTTTCTGCTGACCGACTATGGTGTGA | | | |
| ACTGGGTTCGTCAGAGCCCAGGCAAGGGTCTGGAGTGGCTG | | | |
| GGAGTGATTTGGGGGGATGGAATCACAGACTACAATAGCGC | | | |
| ACTGAAATCTCGGCTGAGTGTTACCAAAGATAACAGCAAGT | | | |
| CCCAGGTCTTCCTGAAGATGAACAGCCTGCAAAGCGGCGAC | | | |
| TCCGCTCGCTATTACTGCGTTACCGGACTGTTTGATTATTG | | | |
| GGGGCAGGGGACAACTCTGACTGTTTCCTCCACCACGACGC | | | |
| CAGCGCCGCGACCACCAACACCGGCGCCCACCATCGCGTCG | | | |
| CAGCCCCTGTCCCTGCGCCCAGAGGCGTGCCGGCCAGCGGC | | | |
| GGGGGCGCAGTGCACACGAGGGGCTGGACTTCGCCTGTG | | | |
| ATATCTACATCTGGGCGCCCTTGGCCGGGACTTGTGGGGTC | | | |
| CTTCTCCTGTCACTGGTTATCACCCTTTACTGCAAACGGGG | | | |
| CAGAAAGAAACTCCTGTATATATTCAAACAACCATTTATGA | | | |
| GACCAGTACAAACTACTCAAGAGGAAGATGGCTGTAGCTGC | | | |
| CGATTTCCAGAAGAAGAAGAAGGAGGATGTGAACTGAGAGT | | | |
| GAAGTTCAGCAGGAGCGCAGACGCCCCGCGTACAAGCAGG | | | |
| GCCAGAACCAGCTCTATAACGAGCTCAATCTAGGACGAAGA | | | |
| GAGGAGTACGATGTTTTGGACAAGAGACGTGGCCGGGACCC | | | |
| TGAGATGGGGGAAAGCCGAGAAGGAAGAACCCTCAGGAAG | | | |
| GCCTGTACAATGAACTGCAGAAAGATAAGATGGCGGAGGCC | | | |
| TACAGTGAGATTGGGATGAAAGGCGAGCGCCGGAGGGGCAA | | | |
| GGGGCACGATGGCCTTTACCAGGGTCTCAGTACAGCCACCA | | | |

TABLE 3-continued

SEQUENCES
Sequence Table

| Sequence | Seq id no | Name | ID |
|---|---|---|---|
| AGGACACCTACGACGCCCTTCACATGCAGGCCCTGCCCCCT CGCTAAGTCGACAATCAACCTCTGGATTACAAAATTTGTGA AAGATTGACTGGTATTCTTAACTATGTTGCTCCTTTTACGC TATGTGGATACGCTGCTTTAATGCCTTTGTATCATGCTATT GCTTCCCGTATGGCTTTCATTTTCTCCTCCTTGTATAAATC CTGGTTGCTGTCTCTTTATGAGGAGTTGTGGCCCGTTGTCA GGCAACGTGGCGTGGTGTGCACTGTGTTTGCTGACGCAACC CCCACTGGTTGGGGCATTGCCACCACCTGTCAGCTCCTTTC CGGGACTTTCGCTTTCCCCCTCCCTATTGCCACGGCGGAAC TCATCGCCGCCTGCCTTGCCCGCTGCTGGACAGGGGCTCGG CTGTTGGGCACTGACAATTCCGTGGTGTTGTCGGGGAAGCT GACGTCCTTTCCATGGCTGCTCGCCTGTGTTGCCACCTGGA TTCTGCGCGGGACGTCCTTCTGCTACGTCCCTTCGGCCCTC AATCCAGCGGACCTTCCTTCCCGCGGCCTGCTGCCGGCTCT GCGGCCTCTTCCGCGTCTTCGCCTTCGCCCTCAGACGAGTC GGATCTCCCTTTGGGCGCCTCCCCGCCTGGAATTCGAGCT CGGTACCTTTAAGACCAATGACTTACAAGGCAGCTGTAGAT CTTAGCCACTTTTTAAAAGAAAAGGGGGGACTGGAAGGGCT AATTCACTCCCAACGAAGACAAGATCTGCTTTTTGCTTGTA CTGGGTCTCTCTGGTTAGACCAGATCTGAGCCTGGGAGCTC TCTGGCTAACTAGGGAACCCACTGCTTAAGCCTCAATAAAG CTTGCCTTGAGTGCTTCAAGTAGTGTGTGCCCGTCTGTTGT GTGACTCTGGTAACTAGAGATCCCTCAGACCCTTTTAGTCA GTGTGGAAAATCTCTAGCAGTAGTAGTTCATGTCATCTTAT TATTCAGTATTTATAACTTGCAAAGAAATGAATATCAGAGA GTGAGAGGAACTTGTTTATTGCAGCTTATAATGGTTACAAA TAAAGCAATAGCATCACAAATTTCACAAATAAAGCATTTTT TTCACTGCATTCTAGTTGTGGTTTGTCCAAACTCATCAATG TATCTTATCATGTCTGGCTCTAGCTATCCCGCCCCTAACTC CGCCCAGTTCCGCCCATTCTCCGCCCCATGGCTGACTAATT TTTTTTATTTATGCAGAGGCCGAGGCCGCCTCGGCCTCTGA GCTATTCCAGAAGTAGTGAGGAGGCTTTTTTGGAGGCCTAG GCTTTTTGCGTCGAGACGTACCCAATTCGCCCTATAGTGAGT CGTATTACGCGCGCTCACTGGCCGTCGTTTTACAACGTCGT GACTGGGAAAACCCTGGCGTTACCCAACTTAATCGCCTTGC AGCACATCCCCCTTTCGCCAGCTGGCGTAATAGCGAAGAGG CCCGCACCGATCGCCCTTCCCAACAGTTGCGCAGCCTGAAT GGCGAATGGCGCGACGCGCCTGTAGCGGCGCATTAAGCGC GGCGGGTGTGGTGGTTACGCGCAGCGTGACCGCTACACTTG CCAGCGCCCTAGCGCCCGCTCCTTTCGCTTTCTTCCCTTCC TTTCTCGCCACGTTCGCCGGCTTTCCCCGTCAAGCTCTAAA TCGGGGGCTCCCTTTAGGGTTCCGATTTAGTGCTTTACGGC ACCTCGACCCCAAAAAACTTGATTAGGGTGATGGTTCACGT AGTGGGCCATCGCCCTGATAGACGGTTTTTCGCCCTTTGAC GTTGGAGTCCACGTTCTTTAATAGTGGACTCTTGTTCCAAA CTGGAACAACACTCAACCCTATCTCGGTCTATTCTTTTGAT TTATAAGGGATTTTGCCGATTTCGGCCTATTGGTTAAAAAA TGAGCTGATTTAACAAAAATTTAACGCGAATTTTAACAAAA TATTAACGTTTACAATTTCC | | | |
| DIVMTQTPLTLSVTFGQPASISCKSSQSLLDSDGQTYLNWL LQRPGQSPKRLIYLVSKLDSGVPDRFTGSGSGTDFTLKISR VEAEDLGVYYCWQGTHFPWTFGGGTKLEIKGGGGSGGGGSG GGGSEVQLQQSGAELVKPGASVKLSCTASGFNIKDYYMHWV KQRTEQGLEWIGRIDPEDGETKYAPKFQGKATITADTSSKT AYLQLSSLTSEDTAVYYCARLKGGYWGQGTTLTVSSESKYG PPCPPCPDIYIWAPLAGTCGVLLLSLVITLYCKRGRKKLLY IFKQPFMRPVQTTQEEDGCSCRFPEEEEGGCELRVKFSRSA DAPAYKQGQNQLYNELNLGRREEYDVLDKRRGRDPEMGGKP RRKNPQEGLYNELQKDKMAEAYSEIGMKGERRRGKGHDGLY QGLSTATKDTYDALHMQALPPR | 67 | CAR-FLAG_(IgG4m_hinge) | Amino Acid |
| ATGGCCTTACCAGTGACCGCCTTGCTCCTGCCGCTGGCCTT GCTGCTCCACGCCGCCAGGCCGGACGCCGTTGTGACCCAGG AATCCGCTCTGACCTCTTCTCCAGGCGAAACCGTGACTCTG ACTTGCCGTAGTAGCACCGGGGCTGTGACCACATCTAACTA TGCCAGTTGGGTCCAGGAAAAACCGGATCACCTGTTTACTG GCCTGATTGGCGGCACCAACAATCGCGCACCGGGTGTGCCC GCTCGTTTCAGCGGTTCCCTGATTGGGGACAAGGCAGCACT GACTATCACCGGCGCCCAGACCGAAGATGAGGCGATCTATT TTTGCGTCCTGTGGTACAGCGACCATTGGGTGTTCGGGGGA GGCACCAAACTGACAGTGCTGGCGGAGGAGGAGGTTCAGG AGGAGGAGGTAGCGGGGAGGCGGTTCCGGGGGAGGCGGTT CTGATGTGCAGCTGCAAGAATCCGGGCCAGGACTGGTTGCG | 68 | LV-EF1a-GCN4(52SR4)-BBZ_IgG4(Pro) | DNA |

TABLE 3-continued

SEQUENCES
Sequence Table

| Sequence | Seq id no | Name | ID |
|---|---|---|---|
| CCTTCTCAGAGTCTGTCAATTACATGTACTGTTAGTGGCTT<br>TCTGCTGACCGACTATGGTGTGAACTGGGTTCGTCAGAGCC<br>CAGGCAAGGGTCTGGAGTGGCTGGGAGTGATTTGGGGGGAT<br>GGAATCACAGACTACAATAGCGCACTGAAATCTCGGCTGAG<br>TGTTACCAAAGATAACAGCAAGTCCCAGGTCTTCCTGAAGA<br>TGAACAGCCTGCAAAGCGGCGACTCCGCTCGCTATTACTGC<br>GTTACCGGACTGTTTGATTATTGGGGCAGGGGACAACTCT<br>GACTGTTTCCTCCGAAAGCAAGTATGCCCACCTTGTCCAA<br>GCTGTCCCGATATCTACATCTGGGCGCCCTTGGCCGGGACT<br>TGTGGGGTCCTTCTCCTGTCACTGGTTATCACCCTTTACTG<br>CAAACGGGGCAGAAAGAAACTCCTGTATATATTCAAACAAC<br>CATTTATGAGACCAGTACAAACTACTCAAGAGGAAGATGGC<br>TGTAGCTGCCGATTTCCAGAAGAAGAAGAAGGAGGATGTGA<br>ACTGAGAGTGAAGTTCAGCAGGAGCGCAGACGCCCCCGCGT<br>ACAAGCAGGGCCAGAACCAGCTCTATAACGAGCTCAATCTA<br>GGACGAAGAGAGGAGTACGATGTTTTGGACAAGAGACGTGG<br>CCGGGACCCTGAGATGGGGGGAAAGCCGAGAAGGAAGAACC<br>CTCAGGAAGGCCTGTACAATGAACTGCAGAAAGATAAGATG<br>GCGGAGGCCTACAGTGAGATTGGGATGAAAGGCGAGCGCCG<br>GAGGGGCAAGGGGCACGATGGCCTTTACCAGGGTCTCAGTA<br>CAGCCACCAAGGACACCTACGACGCCCTTCACATGCAGGCC<br>CTGCCCCCTCGC | | | |
| ATGGCCTTACCAGTGACCGCCTTGCTCCTGCCGCTGGCCTT<br>GCTGCTCCACGCCGCCAGGCCGGACGCCGTTGTGACCCCAGG<br>AATCCGCTCTGACCTCTTCTCCAGGCGAAACCGTGACTCTG<br>ACTTGCCGTAGTAGCACCGGGGCTGTGACCACATCTAACTA<br>TGCCAGTTGGGTCCAGGAAAAACCGGATCACTGTTTACTG<br>GCCTGATTGGCGGCACCAACAATCGCGCACCGGGTGTGCCC<br>GCTCGTTTCAGCGGTTCCCTGATTGGGACAAGGCAGCACT<br>GACTATCACCGGCGCCCAGACCGAAGATGAGGCGATCTATT<br>TTTGCGTCCTGTGGTACAGCGACCATTGGTGTTCGGGGGA<br>GGCACCAAACTGACAGTGCTGGGCGGAGGAGGAGGTTCAGG<br>AGGAGGAGGTAGCGGGGAGGCGGTTCCGGGGAGGCGGTT<br>CTGATGTGCAGCTGCAAGAATCCGGGCCAGGACTGGTTGCG<br>CCTTCTCAGAGTCTGTCAATTACATGTACTGTTAGTGGCTT<br>TCTGCTGACCGACTATGGTGTGAACTGGGTTCGTCAGAGCC<br>CAGGCAAGGGTCTGGAGTGGCTGGGAGTGATTTGGGGGGAT<br>GGAATCACAGACTACAATAGCGCACTGAAATCTCGGCTGAG<br>TGTTACCAAAGATAACAGCAAGTCCCAGGTCTTCCTGAAGA<br>TGAACAGCCTGCAAAGCGGCGACTCCGCTCGCTATTACTGC<br>GTTACCGGACTGTTTGATTATTGGGGCAGGGGACAACTCT<br>GACTGTTTCCTCCGAAAGCAAGTATGGCCCACCTTGTCCAC<br>CTTGTCCCGATATCTACATCTGGGCGCCCTTGGCCGGGACT<br>TGTGGGGTCCTTCTCCTGTCACTGGTTATCACCCTTTACTG<br>CAAACGGGGCAGAAAGAAACTCCTGTATATATTCAAACAAC<br>CATTTATGAGACCAGTACAAACTACTCAAGAGGAAGATGGC<br>TGTAGCTGCCGATTTCCAGAAGAAGAAGAAGGAGGATGTGA<br>ACTGAGAGTGAAGTTCAGCAGGAGCGCAGACGCCCCCGCGT<br>ACAAGCAGGGCCAGAACCAGCTCTATAACGAGCTCAATCTA<br>GGACGAAGAGAGGAGTACGATGTTTTGGACAAGAGACGTGG<br>CCGGGACCCTGAGATGGGGGGAAAGCCGAGAAGGAAGAACC<br>CTCAGGAAGGCCTGTACAATGAACTGCAGAAAGATAAGATG<br>GCGGAGGCCTACAGTGAGATTGGGATGAAAGGCGAGCGCCG<br>GAGGGGCAAGGGGCACGATGGCCTTTACCAGGGTCTCAGTA<br>CAGCCACCAAGGACACCTACGACGCCCTTCACATGCAGGCC<br>CTGCCCCCTCGC | 69 | LV-EF1a-<br>GCN4(52SR4)-<br>BBZ_IgG4(Ser) | DNA |
| ATGGCCTTACCAGTGACCGCCTTGCTCCTGCCGCTGGCCTTGCTG<br>CTCCACGCCGCCAGGCCGCAGGCGGTAGTCACCCAGGAGCCAA<br>GTCTCACGGTGAGCCCCGGCGGTACCGTCACACTTACATGCGGA<br>AGCTCTACCGGGGCTGTGACCACAAGCAACTACGCATCCTGGGT<br>CCAGCAGAAACCCGGTCAGGCTCCTCGGGGCCTCATTGGTGGGA<br>CAAATAACAGAGCCCCGGGTGTTCCCGCCCGATTTTCTGGCAGTC<br>TTCTGGGAGGAAAGGCCGCTCTGACAATATCTGGCGCACAGCCC<br>GAAGACGAGGCCGAGTACTATTGCGTGTTGTGGTATAGCGACCA<br>CTGGGTATTCGGTGGAGGAACAAAGCTGACAGTGCTCGGCGT<br>GGAGGGAGTGGTGGCGGTGGCAGCGGAGGGGCGGATCACAA<br>GTGCAATTGCAGGAGAGTGGACCTGGACTCGTGAAACATCTGA<br>AACACTCTCCCTGACTTGTACGGTTTCAGGGTTCCTGCTGACAGA<br>CTATGGAGTAAACTGGATCAGGCAGCCACCCGGCAAGGGCTTG<br>GAGTGGATTGGCGTCATTTGGGGCGACGGAATCACCGACTATAA<br>CCCATCACTCAAATCTCGGGTGACCATTTCCAAGGATACCAGTAA<br>GAATCAGTTCAGCCTGAAACTTTCATCCGTGACAGCTGCGGACAC | 70 | LV-EF1a-<br>huGCN4-<br>BBZ_L2, H2 | DNA |

TABLE 3-continued

SEQUENCES
Sequence Table

| Sequence | Seq id no | Name | ID |
|---|---|---|---|
| CGCCGTGTACTACTGTGTGACAGGACTTTTTGACTACTGGGGCCA<br>GGGGACCCTGGTGACAGTTAGCTCCACCACGACGCCAGCGCCGC<br>GACCACCAACACCGGCGCCCACCATCGCGTCGCAGCCCCTGTCCC<br>TGCGCCCAGAGGCGTGCCGGCCAGCGGCGGGGGGCGCAGTGCA<br>CACGAGGGGGCTGGACTTCGCCTGTGATATCTACATCTGGGCGC<br>CCTTGGCCGGGACTTGTGGGGTCCTTCTCCTGTCACTGGTTATCA<br>CCCTTTACTGCAAACGGGGCAGAAAGAAACTCCTGTATATATTCA<br>AACAACCATTTATGAGACCAGTACAAACTACTCAAGAGGAAGAT<br>GGCTGTAGCTGCCGATTTCCAGAAGAAGAAGAAGGAGGATGTG<br>AACTGAGAGTGAAGTTCAGCAGGAGCGCAGACGCCCCGCGTA<br>CAAGCAGGGCCAGAACCAGCTCTATAACGAGCTCAATCTAGGAC<br>GAAGAGAGGAGTACGATGTTTTGGACAAGAGACGTGGCCGGGA<br>CCCTGAGATGGGGGAAAGCCGAGAAGGAAGAACCCTCAGGAA<br>GGCCTGTACAATGAACTGCAGAAAGATAAGATGGCGGAGGCCT<br>ACAGTGAGATTGGGATGAAAGGCGAGCGCCGGAGGGGCAAGG<br>GGCACGATGGCCTTTACCAGGGTCTCAGTACAGCCACCAAGGAC<br>ACCTACGACGCCCTTCACATGCAGGCCCTGCCCCCTCGC | | | |
| atggccttaccagtgaccgccttgctcctgccgctggccttgctgctccacgccgccag<br>gccgCAGGCGGTAGTCACCCAGGAGCCAAGTCTCACGGTGAGCC<br>CCGGCGGTACCGTCACACTTACATGCGGAAGCTCTACCGGGGCT<br>GTGACCACAAGCAACTACGCATCCTGGGTCCAGCAGAAACCCGG<br>TCAGGCGCCCCGGGGCCTCATTGGTGGGACAAATAACAGAGCCC<br>CGGGTGTTCCCGCCCGATTTTCTGGCAGTCTTCTGGGAGGAAAG<br>GCCGCTCTGACAATATCTGGCGCACAGCCCGAAGACGAGGCCGA<br>GTACTATTGCGTGTTGTGGTATAGCGACCACTGGGTATTCGGTG<br>GAGGAACAAAGCTGACAGTGCTCGGCGGTGGAGGGAGTGGTG<br>GCGGTGGCAGCGGAGGGGCGGATCACAAGTGCAATTGCAGG<br>AGAGTGGACCTGGACTCGTGAAACCATCTGAAACACTCTCCATA<br>ACTTGTACGGTTTCAGGGTTCCTGCTGACAGACTATGGAGTAAAC<br>TGGGTTAGGCAGCCACCCGGCAAGGGCTTGGAGTGGCTGGGCG<br>TCATTTGGGGCGACGGAATCACCGACTATAACCCATCACTCAAAT<br>CTCGGCTTACCGTCTCCAAGGATACGAGTAAGAATCAGGTCAGC<br>CTGAAAATGTCATCCCTCACAGCTGCGGACACCGCCGTGTACTAC<br>TGTGTGACAGGACTTTTTGACTACTGGGGCCAGGGGACCCTGCT<br>CACAGTTAGCTCCaccacgacgccagcgccgcgaccaccaacaccggcgccca<br>ccatcgcgtcgcagcccctgtccctgcgcccagaggcgtgccggccagcggcggggg<br>gcgcagtgcacacgaggggctggacttcgcctgtgatatctacatctgggcgcctt<br>ggccgggacttgtgggtccttctcctgtcactggttatcacccttactgcaaacggg<br>gcagaaagaaactcctgtatatattcaaacaaccatttatgagaccagtacaaacta<br>ctcaagaggaagatggctgtagctgccgatttccagaagaagaagaaggaggatgt<br>gaactgagagtgaagttcagcaggagcgcagacgcccccgcgtacaagcagggcca<br>gaaccagctctataacgagctcaatctaggacgaagagaggagtacgatgttttgga<br>caagagacgtggccgggacccctgagatgggggaaagccgagaaggaagaaccct<br>caggaaggcctgtacaatgaactgcagaaagataagatggcggaggcctacagtga<br>gattgggatgaaaggcgagcgccggaggggcaaggggcacgatggcctttaccagg<br>gtctcagtacagccaccaaggacacctacgacgcccttcacatgcaggccctgcccc<br>ctcgc | 71 | LV-EF1a-<br>huGCN4-<br>BBZ_L2, H3 | DNA |
| atggccttaccagtgaccgccttgctcctgccgctggccttgctgctccacgccgccag<br>gccgCAGGCGGTAGTCACCCAGGAGCCAAGTCTCACGGTGAGCC<br>CCGGCGGTACCGTCACACTTACATGCGGAAGCTCTACCGGGGCT<br>GTGACCACAAGCAACTACGCATCCTGGGTCCAGCAGAAACCCGG<br>ACAAGCGTTCCGGGGCCTCATTGGTGGGACAAATAACAGAGCCC<br>CGGGTGTTCCCGCCCGATTTTCTGGCAGTCTTCTGGGAGGAAAG<br>GCCGCTCTGACAATATCTGGCGCACAGCCCGAAGACGAGGCCGA<br>GTACTATTGCGTGTTGTGGTATAGCGACCACTGGGTATTCGGTG<br>GAGGAACAAAGCTGACAGTGCTCGGCGGTGGAGGGAGTGGTG<br>GCGGTGGCAGCGGAGGGGCGGATCACAAGTGCAATTGCAGG<br>AGAGTGGACCTGGACTCGTGAAACCATCTGAAACACTCTCCCTCA<br>CTTGTACGGTTTCAGGGTTCCTGCTGACAGACTATGAGTAAACT<br>GGATTAGGCAGCCACCCGGCAAGGGCTTGGAGTGGATCGGCGT<br>CATTTGGGGCGACGGAATCACCGACTATAACCCATCACTCAAATC<br>TCGGGTCACCATCTCCAAGGATACCAGTAAGAATCAGTTCAGCCT<br>GAAACTGTCATCCGTCACAGCTGCGGACACCGCCGTGTACTACT<br>GTGTGACAGGACTTTTTGACTACTGGGGCCAGGGGACCCTGGTA<br>ACAGTTAGCTCCaccacgacgccagcgccgcgaccaccaacaccggcgccac<br>catcgcgtcgcagcccctgtccctgcgcccagaggcgtgccggccagcggcggggg<br>cgcagtgcacacgaggggctggacttcgcctgtgatatctacatctgggcgcccttg<br>gccgggacttgtgggtccttctcctgtcactggttatcacccttactgcaaacggg<br>cagaaagaaactcctgtatatattcaaacaaccatttatgagaccagtacaaactact<br>caagaggaagatggctgtagctgccgatttccagaagaagaagaaggaggatgtga<br>actgagagtgaagttcagcaggagcgcagacgcccccgcgtacaagcagggccaga<br>accagctctataacgagctcaatctaggacgaagagaggagtacgatgttttggaca | 72 | LV-EF1a-<br>huGCN4-<br>BBZ_L3, H2 | DNA |

TABLE 3-continued

SEQUENCES
Sequence Table

| Sequence | Seq id no | Name | ID |
|---|---|---|---|
| agagacgtggccgggaccctgagatggggggaaagccgagaaggaagaaccctca ggaaggcctgtacaatgaactgcagaaagataagatggcggaggcctacagtgaga ttgggatgaaaggcgagcgccggaggggcaaggggcacgatggcctttaccagggt ctcagtacagccaccaaggacacctacgacgcccttcacatgcaggccctgcccctc gc | | | |
| atggccttaccagtgaccgccttgctcctgccgctggccttgctgctccacgccgccag gccgCAGGCGGTAGTCACCCAGGAGCCAAGTCTCACGGTGAGCC CCGGCGGTACCGTCACACTTACATGCGGAAGCTCTACCGGGGCT GTGACCACAAGCAACTACGCATCCTGGGTCCAGCAGAAACCCGG TCAGGCATTCCGGGGCCTCATTGGTGGGACAAATAACAGAGCC CGGGTGTTCCCGCCCGATTTTCTGGCAGTCTTCTGGGAGGAAAG GCCGCTCTGACAATATCTGGCGCACAGCCCGAAGACGAGGCCGA GTACTATTGCGTGTTGTGGTATAGCGACCACTGGGTATTCGGTG GAGGAACAAAGCTGACAGTGCTCGGCGGTGGAGGGAGTGGTG GCGGTGGCAGCGGAGGGGGCGGATCACAAGTGCAATTGCAGG AGAGTGGACCTGGACTCGTGAAACCATCTGAAACACTCTCCATA ACTTGTACGGTTTCAGGGTTCCTGCTGACAGACTATGGAGTAAAC TGGGTCAGGCAGCCACCCGGCAAGGGCTTGGAGTGGCTCGGCG TCATTTGGGGCGACGGAATCACCGACTATAACCCATCACTCAAAT CTCGGTTGACCGTGTCCAAGGATACCAGTAAGAATCAGGTCAGC CTGAAAATGTCATCCCTGACAGCTGCGGACACCGCCGTGTACTAC TGTGTGACAGGACTTTTTGACTACTGGGGCCAGGGGACCCTGTT GACAGTTAGCTCCaccacgacgccagcgccgcgaccaccaacaccggcgccc accatcgcgtcgcagccctgtccctgcgcccagaggcgtgccggccagcggcgggg ggcgcagtgcacacgagggggctggacttcgcctgtgatatctacatctgggcgccct tggccgggacttgtggggtccttctcctgtcactggttatcacccttttactgcaaacggg gcagaaagaaactcctgtatatattcaaacaaccatttatgagaccagtacaaacta ctcaagaggaagatggctagctgccgatttccagaagaagaagaaggaggatgt gaactgagagtgaagttcagcaggagcgcagacgcccccgcgtacaagcagggcca gaaccagctctataacgagctcaatctaggacgaagagaggagtacgatgttttgga caagagacgtggccgggaccctgagatggggggaaagccgagaaggaagaaccct caggaaggcctgtacaatgaactgcagaaagataagatggcggaggcctacagtga gattgggatgaaaggcgagcgccggaggggcaaggggcacgatggcctttaccagg gtctcagtacagccaccaaggacacctacgacgcccttcacatgcaggccctgcccc ctcgc | 73 | LV-EF1a-huGCN4-BBZ_L3, H3 | DNA |
| atggccttaccagtgaccgccttgctcctgccgctggccttgctgctccacgccgccag gccgCAGGCGGTAGTCACCCAGGAGCCAAGTCTCACGGTGAGCC CCGGCGGTACCGTCACACTTACATGCGGAAGCTCTACCGGGGCT GTGACCACAAGCAACTACGCATCCTGGGTCCAGCAGAAACCCGA TCACCTGTTCCGGGGCCTCATTGGTGGGACAAATAACAGAGCCC CGGGTGTTCCCGCCCGATTTTCTGGCAGTCTTCTGGGAGGAAAG GCCGCTCTGACAATATCTGGCGCACAGCCCGAAGACGAGGCCGA GTACTATTGCGTGTTGTGGTATAGCGACCACTGGGTATTCGGTG GAGGAACAAAGCTGACAGTGCTCGGCGGTGGAGGGAGTGGTG GCGGTGGCAGCGGAGGGGGCGGATCACAAGTGCAATTGCAGG AGAGTGGACCTGGACTCGTGAAACCATCTGAAACACTCTCCCTTA CTTGTACGGTTTCAGGGTTCCTGCTGACAGACTATGGAGTAAACT GGATCAGGCAGCCACCCGGCAAGGGCTTGGAGTGGATCGGCGT CATTTGGGGCGACGGAATCACCGACTATAACCCATCACTCAAATC TCGGGTCACCATCTCCAAGGATACGAGTAAGAATCAGTTCAGCC TGAAACTCTCATCCGTTACAGCTGCGGACACCGCCGTGTACTACT GTGTGACAGGACTTTTTGACTACTGGGGCCAGGGGACCCTGGTA ACAGTTAGCTCCaccacgacgccagcgccgcgaccaccaacaccggcgccac catcgcgtcgcagccctgtccctgcgcccagaggcgtgccggccagcggcgggggg cgcagtgcacacgagggggctggacttcgcctgtgatatctacatctgggcgccttg gccgggacttgtggggtccttctcctgtcactggttatcacccttttactgcaaacggg cagaaagaaactcctgtatatattcaaacaaccatttatgagaccagtacaaactact caagaggaagatggctagctgccgatttccagaagaagaagaaggaggatgtga actgagagtgaagttcagcaggagcgcagacgcccccgcgtacaagcagggccaga accagctctataacgagctcaatctaggacgaagagaggagtacgatgttttggaca agagacgtggccgggaccctgagatggggggaaagccgagaaggaagaaccctca ggaaggcctgtacaatgaactgcagaaagataagatggcggaggcctacagtgaga ttgggatgaaaggcgagcgccggaggggcaaggggcacgatggcctttaccagggt ctcagtacagccaccaaggacacctacgacgcccttcacatgcaggccctgcccc tcgc | 74 | LV-EF1a-huGCN4-BBZ_L4, H2 | DNA |
| atggccttaccagtgaccgccttgctcctgccgctggccttgctgctccacgccgccag gccgCAGGCGGTAGTCACCCAGGAGCCAAGTCTCACGGTGAGCC CCGGCGGTACCGTCACACTTACATGCGGAAGCTCTACCGGGGCT GTGACCACAAGCAACTACGCATCCTGGGTCCAGCAGAAACCCGA CCATCTGTTTCGGGGCCTCATTGGTGGGACAAATAACAGAGCCC CGGGTGTTCCCGCCCGATTTTCTGGCAGTCTTCTGGGAGGAAAG | 75 | LV-EF1a-huGCN4-BBZ_L4, H3 | DNA |

TABLE 3-continued

SEQUENCES
Sequence Table

| Sequence | Seq id no | Name | ID |
|---|---|---|---|
| GCCGCTCTGACAATATCTGGCGCACAGCCCGAAGACGAGGCCGA GTACTATTGCGTGTTGTGGTATAGCGACCACTGGGTATTCGGTG GAGGAACAAAGCTGACAGTGCTCGGCGGTGGAGGGAGTGGTG GCGGTGGCAGCGGAGGGGGCGGATCACAAGTGCAATTGCAGG AGAGTGGACCTGGACTCGTGAAACCATCTGAAACACTCTCCATTA CTTGTACGGTTTCAGGGTTCCTGCTGACAGACTATGGAGTAAACT GGGTGAGGCAGCCACCCGGCAAGGGCTTGGAGTGGCTCGGCGT CATTTGGGGCGACGGAATCACCGACTATAACCCATCACTCAAATC TCGGTTGACCGTGTCCAAGGATACCAGTAAGAATCAGGTGAGCC TGAAAATGTCATCCCTGACAGCTGCGGACACCGCCGTGTACTACT GTGTGACAGGACTTTTTGACTACTGGGGCAGGGGACCCTGCTG ACAGTTAGCTCCaccacgacgccagcgccgcgaccaccaacaccggcgcccac catcgcgtcgcagccctgtccctgcgcccagaggcgtgccggccagcggcgggggg cgcagtgcacacgagggggctggacttcgcctgtgatatctacatctgggcgcccttg gccgggacttgtggggtccttctcctgtcactggttatcaccctttactgcaaacgggg cagaaagaaactcctgtatatattcaaacaaccatttatgagaccagtacaaactact caagaggaagatggctgtagctgccgatttccagaagaagaagaaggaggatgtga actgagagtgaagttcagcaggagcgcagacgcccccgcgtacaagcagggccaga accagctctataacgagctcaatctaggacgaagagaggagtacgatgttttggaca agagacgtggccgggaccctgagatggggggaaagccgagaaggaagaaccctca ggaaggcctgtacaatgaactgcagaaagataagatggcggaggcctacagtgaga ttgggatgaaaggcgagcgccggaggggcaaggggcacgatggcctttaccagggt ctcagtacagccaccaaggacacctacgacgcccttcacatgcaggccctgcccctc gc | | | |
| atggccttaccagtgaccgccttgctcctgccgctggccttgctgctccacgccgccag gccgGACGCCGTTGTGACCCAGGAATCCGCTCTGACCTCTTCTCCA GGCGAAACCGTGACTCTGACTTGCCGTAGTAGCACCGGGGCTGT GACCACATCTAACTATGCCAGTTGGGTCCAGGAAAAACCGGATC ACCTGTTTACTGGCCTGATTGGCGGCACCAACAATCGCGCACCG GGTGTGCCCGCTCGTTTCAGCGGTTCCCTGATTGGGGACAAGGC AGCACTGACTATCACCGGCGCCCAGACCGAAGATGAGGCGATCT ATTTTTGCGTCCTGTGGTACAGCGACCATTGGGTGTTCGGGGGA GGCACCAAACTGACAGTGCTGGGCGGAGGAGGAGGTTCAGGAG GAGGAGGTAGCGGGGGAGGCGGTTCCGGGGGAGGCGGTTCTG ATGTGCAGCTGCAAGAATCCGGGCCAGGACTGGTTGCGCCTTCT CAGAGTCTGTCAATTACATGTACTGTTAGTGGCTTTCTGCTGACC GACTATGGTGTGAACTGGGTTCGTCAGAGCCCAGGCAAGGGTCT GGAGTGGCTGGGAGTGATTTGGGGGGATGGAATCACAGACTAC AATAGCGCACTGAAATCTCGGCTGAGTGTTACCAAAGATAACAG CAAGTCCCAGGTCTTCCTGAAGATGAACAGCCTGCAAAGCGGCG ACTCCGCTCGCTATTACTGCGTTACCGGACTGTTTGATTATTGGG GGCAGGGGACAACTCTGACTGTTTCCTCCaccacgacgccagcgccgc gaccaccaaccaccggcgcccaccatcgcgtcgcagcccctgtccctgcgcccagagg cgtgccggccagcggcgggggcgcagtgcacacgagggggctggacttcgcctgt gatatctacatctgggcgcccttggccgggacttgtggggtccttctcctgtcactggtt atcaccctttactgcaaacggggcagaaagaaactcctgtatatattcaaacaaccat ttatgagaccagtacaaactactcaagaggaagatggctgtagctgccgatttccag aagaagaagaaggaggatgtgaactgagagtgaagttcagcaggagcgcagacgc ccccgcgtacaagcagggccagaaccagctctataacgagctcaatctaggacgaa gagaggagtacgatgttttggacaagagacgtggccgggaccctgagatggggga aagccgagaaggaagaaccctcaggaaggcctgtacaatgaactgcagaaagata agatggcggaggcctacagtgagattgggatgaaaggcgagcgccggaggggcaa ggggcacgatggcctttaccagggtctcagtacagccaccaaggacacctacgacgc ccttcacatgcaggccctgcccctcgc | 76 | LV-EF1a-GCN4(52SR4)-BBZ_CD8 hinge | DNA |
| atggccttaccagtgaccgccttgctcctgccgctggccttgctgctccacgccgccag gccgGACGCCGTTGTGACCCAGGAATCCGCTCTGACCTCTTCTCCA GGCGAAACCGTGACTCTGACTTGCCGTAGTAGCACCGGGGCTGT GACCACATCTAACTATGCCAGTTGGGTCCAGGAAAAACCGGATC ACCTGTTTACTGGCCTGATTGGCGGCACCAACAATCGCGCACCG GGTGTGCCCGCTCGTTTCAGCGGTTCCCTGATTGGGGACAAGGC AGCACTGACTATCACCGGCGCCCAGACCGAAGATGAGGCGATCT ATTTTTGCGTCCTGTGGTACAGCGACCATTGGGTGTTCGGGGGA GGCACCAAACTGACAGTGCTGGGCGGAGGAGGAGGTTCAGGAG GAGGAGGTAGCGGGGGAGGCGGTTCCGGGGGAGGCGGTTCTG ATGTGCAGCTGCAAGAATCCGGGCCAGGACTGGTTGCGCCTTCT CAGAGTCTGTCAATTACATGTACTGTTAGTGGCTTTCTGCTGACC GACTATGGTGTGAACTGGGTTCGTCAGAGCCCAGGCAAGGGTCT GGAGTGGCTGGGAGTGATTTGGGGGGATGGAATCACAGACTAC AATAGCGCACTGAAATCTCGGCTGAGTGTTACCAAAGATAACAG CAAGTCCCAGGTCTTCCTGAAGATGAACAGCCTGCAAAGCGGCG ACTCCGCTCGCTATTACTGCGTTACCGGACTGTTTGATTATTGGG GGCAGGGGACAACTCTGACTGTTTCCTCCgatatctacatctgggcgccc | 77 | LV-EF1a-GCN4(52SR4)-BBZ_no hinge | DNA |

TABLE 3-continued

SEQUENCES
Sequence Table

| Sequence | Seq id no | Name | ID |
|---|---|---|---|
| ttggccgggacttgtggggtccttctcctgtcactggttatcacccctttactgcaaacgg ggcagaaagaaactcctgtatatattcaaacaaccatttatgagaccagtacaaact actcaagaggaagatggctgtagctgccgatttccagaagaagaagaaggaggatg tgaactgagagtgaagttcagcaggagcgcagacgccccccgcgtacaagcagggcc agaaccagctctataacgagctcaatctaggacgaagagaggagtacgatgttttgg acaagagacgtggccgggaccctgagatggggggaaagccgagaaggaagaaccc tcaggaaggcctgtacaatgaactgcagaaagataagatggcggaggcctacagtg agattgggatgaaaggcgagcgccggaggggcaaggggcacgatggcctttaccag ggtctcagtacagccaccaaggacacctacgacgcccttcacatgcaggccctgccc cctcgc | | | |
| DAVVTQESALTSSPGETVTLTCRSSTGAVTTSNYASWVQEK PDHLFTGLIGGTNNRAPGVPARFSGSLIGDKAALTITGAQT EDEAIYFCVLWYSDHWVFGGGTKLTVLGGGGSGGGGSGGG GSGGGGSDVQLQESGPGLVAPSQSLSITCTVSGFLLTDYGV NWVRQSPGKGLEWLGVIWGDGITDYNSALKSRLSVTKDNSK SQVFLKMNSLQSGDSARYYCVTGLFDYWGQGTTLTVSSTTT PAPRPPTPAPTIASQPLSLRPEACRPAAGGAVHTRGLDFAC DIYIWAPLAGTCGVLLLSLVITLYCKRGRKKLLYIFKQPFM RPVQTTQEEDGCSCRFPEEEEGGCELRVKFSRSADAPAYKQ GQNQLYNELNLGRREEYDVLDKRRGRDPEMGGKPRRKNPQE GLYNELQKDKMAEAYSEIGMKGERRRGKGHDGLYQGLSTAT KDTYDALHMQALPPR | 85 | CAR-GCN4 (CD8 hinge) | Amino Acid |
| DAVVTQESALTSSPGETVTLTCRSSTGAVTTSNYASWVQEK PDHLFTGLIGGTNNRAPGVPARFSGSLIGDKAALTITGAQT EDEAIYFCVLWYSDHWVFGGGTKLTVLGGGGSGGGGSGGG GSGGGGSDVQLQESGPGLVAPSQSLSITCTVSGFLLTDYGV NWVRQSPGKGLEWLGVIWGDGITDYNSALKSRLSVTKDNSK SQVFLKMNSLQSGDSARYYCVTGLFDYWGQGTTLTVSSESK YGPPCPPCPDIYIWAPLAGTCGVLLLSLVITLYCKRGRKKL LYIFKQPFMRPVQTTQEEDGCSCRFPEEEEGGCELRVKFSR SADAPAYKQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR | 86 | CAR-GCN4 (IgG4m hinge) | Amino Acid |
| GGGGS | 93 | GGGGS linker | Amino Acid |
| GGGS | 94 | GGGS linker | Amino Acid |
| GGS | 95 | GGS linker | Amino Acid |
| GS | 96 | GS linker | Amino Acid |
| (X$_m$S)$_n$, n is at least 1, m is at least 1 and X is an amino acid | 97 | XS linker | Amino Acid |
| LVGEAAAKEAAAKA | 98 | rigid switch fusion/grafting linker 3 | Amino Acid |
| AEAAAKEAAAKA | 99 | rigid switch fusion/grafting linker 4 | Amino Acid |
| EAAAKEAAAKEAAAKA | 100 | rigid switch fusion/grafting linker 4a | Amino Acid |
| EGKSSGSGSESKST | 101 | flexible switch fusion/grafting linker-prophetic | Amino Acid |

TABLE 3-continued

SEQUENCES
Sequence Table

| Sequence | Seq id no | Name | ID |
|---|---|---|---|
| GSAGSAAGSGEF | 102 | rigid switch fusion/grafting linker 5 | Amino Acid |
| APAPAPAPAPAPAP | 103 | prolyl switch fusion/grafting linker-prophetic | Amino Acid |
| tcgagaagcttgccaccatgggtgtccctacccagctcctg<br>ggactgctcctgctgtggatcaccgacgccatctgcGACGC<br>CGTTGTGACCCAGGAATCCGCTCTGACCTCTTCTCCAGGCG<br>AAACCGTGACTCTGACTTGCCGTAGTAGCACCGGGGCTGTG<br>ACCACATCTAACTATGCCAGTTGGGTCCAGGAAAAACCGGA<br>TCACCTGTTTACTGGCCTGATTGGCGGCACCAACAATCGCG<br>CACCGGGTGTGCCCGCTCGTTTCAGCGGTTCCCTGATTGGG<br>GACAAGGCAGCACTGACTATCACCGGCGCCCAGACCGAAGA<br>TGAGGCGATCTATTTTTGCGTCCTGTGGTACAGCGACCATT<br>GGGTGTTCGGGGGAGGCACCAAACTGACAGTGCTGGGCGGA<br>GGAGGAGGTTCAGGAGGAGGAGGTAGCGGGGGAGGCGGTTC<br>CGGGGGAGGCGGTTCTGATGTGCAGCTGCAAGAATCCGGGC<br>CAGGACTGGTTGCGCCTTCTCAGAGTCTGTCAATTACATGT<br>ACTGTTAGTGGCTTTCTGCTGACCGACTATGGTGTGAACTG<br>GGTTCGTCAGAGCCCAGGCAAGGGTCTGGAGTGGCTGGGAG<br>TGATTTGGGGGATGGAATCACAGACTACAATAGCGCACTG<br>AAATCTCGGCTGAGTGTTACCAAAGATAACAGCAAGTCCCA<br>GGTCTTCCTGAAGATGAACAGCCTGCAAAGCGGCGACTCCG<br>CTCGCTATTACTGCGTTACCGGACTGTTTGATTATTGGGGG<br>CAGGGGACAACTCTGACTGTTTCCTCcatcgagttcatgta<br>cccccctccctacctggacaacgagagaagcaacggcacca<br>tcatccacatcaaagaaaagcacctgtgccacacccagagc<br>agccccaagctgttctgggccctggtggtggtggccggcgt<br>gctgttctgttacggcctgctggtcacagtggccctgtgcg<br>tgatctggaccaacagcagaagaaacagaggcggccagagc<br>gactacatgaacatgaccccccagaaggccaggcctgaccag<br>aaagcccaccagccctacgcccctgccagagacttcgccg<br>cctacagacccagagccaagttcagcagatccgccgagaca<br>gccgccaacctgcaggatcccaaccagctgttcaacgagct<br>gaacctgggcagacgggaggaattcgacgtgctggaaaaga<br>agagagccagggaccccgagatgggcggcaagcagcagaga<br>agaagaaaccctcaggaaggcgtctacaacgccctgcagaa<br>agacaagatggccgaggcctcagcgagatcggcaccaagg<br>gcgagagaaggggcaagggccacgatggcctgttccag<br>ggcctgtccaccgccaccaaggacaccttcgacgccctgca<br>catgcagaccctggcccccagatgagtcgacggtaccgcgg<br>gcccgggatccgataaaataaaagattttatttagtctcca<br>gaaaaaggggggaatgaaagaccccacctgtaggtttggca<br>agctagcttaagtaacgccattttgcaaggcatggaaaata<br>cataactgagaatagagaagttcagatcaaggttaggaaca<br>gagagacagcagaatatgggccaaacaggatatctgtggta<br>agcagttcctgccccggctcagggccaagaacagatggtcc<br>ccagatgcggtcccgccctcagcagtttctagagaaccatc<br>agatgtttccagggtgccccaaggacctgaaaatgaccctg<br>tgccttatttgaactaaccaatcagttcgcttctcgcttct<br>gttcgcgcgcttctgctccccgagctcaataaaagagccca<br>caaccccteactcggcgcgccagtcctccgatagactgcgt<br>cgcccgggtacccgtgtatccaataaaccctcttgcagttg<br>catccgacttgtggtctcgctgttccttgggagggtctcct<br>ctgagtgattgactacccgtcagcgggggtctttcatgggt<br>aacagtttcttgaagttggagaacaacattctgagggtagg<br>agtcgaatattaagtaatcctgactcaattagccactgttt<br>tgaatccacatactcctgaaatccatcgatgga<br>gttcattatggacagcgcagaaagagctggggagaattgtg<br>aaattgttatccgctcacaattccacacaacatacgagccg<br>gaagcataaagtgtaaagcctggggtgcctaatgagtgagc<br>taactcacattaattgcgttgcgctcactgcccgctttcca<br>gtcgggaaacctgtcgtgccagctgcattaatgaatcggcc<br>aacgcgcggggagaggcggtttgcgtattgggcgctcttcc<br>gcttcctcgctcactgactcgctgcgctcggtcgttcggct<br>gcggcgagcggtatcagctcactcaaaggcggtaatacggt<br>tatccacagaatcaggggataacgcaggaaagaacatgtga | 104 | GCN4-CD28-CD3z(1-3) | DNA |

TABLE 3-continued

SEQUENCES
Sequence Table

| Sequence | Seq id no | Name | ID |
|---|---|---|---|
| gcaaaaggccagcaaaaggccaggaaccgtaaaaaggccgc | | | |
| gttgctggcgttttccataggctccgcccccctgacgagc | | | |
| atcacaaaaatcgacgctcaagtcagaggtggcgaaacccg | | | |
| acaggactataaagataccaggcgtttccccctggaagctc | | | |
| cctcgtgcgctctcctgttccgaccctgccgcttaccggat | | | |
| acctgtccgcctttctcccttcgggaagcgtggcgctttct | | | |
| catagctcacgctgtaggtatctcagttcggtgtaggtcgt | | | |
| tcgctccaagctgggctgtgtgcacgaaccccccgttcagc | | | |
| ccgaccgctgcgccttatccggtaactatcgtcttgagtcc | | | |
| aacccggtaagacacgacttatcgccactggcagcagccac | | | |
| tggtaacaggattagcagagcgaggtatgtaggcggtgcta | | | |
| cagagttcttgaagtggtggcctaactacggctacactaga | | | |
| aggacagtatttggtatctgcgctctgctgaagccagttac | | | |
| cttcggaaaaagagttggtagctcttgatccggcaaacaaa | | | |
| ccaccgctggtagcggtggtttttttgtttgcaagcagcag | | | |
| attacgcgcagaaaaaaaggatctcaagaagatcctttgat | | | |
| cttttctacggggtctgacgctcagtggaacgaaaactcac | | | |
| gttaagggattttggtcatgagattatcaaaaaggatcttc | | | |
| acctagatccttttaaattaaaaatgaagttttaaatcaat | | | |
| ctaaagtatatatgagtaaacttggtctgacagttaccaat | | | |
| gcttaatcagtgaggcacctatctcagcgatctgtctattt | | | |
| cgttcatccatagttgcctgactccccgtcgtgtagataac | | | |
| tacgatacgggagggcttaccatctggccccagtgctgcaa | | | |
| tgataccgcgagacccacgctcaccggctccagatttatca | | | |
| gcaataaaccagccagccgaagggccgagcgcagaagtgg | | | |
| tcctgcaactttatccgcctccatccagtctattaattgtt | | | |
| gccgggaagctagagtaagtagttcgccagttaatagtttg | | | |
| cgcaacgttgttgccattgctacaggcatcgtggtgtcacg | | | |
| ctcgtcgtttggtatggcttcattcagctccggttcccaac | | | |
| gatcaaggcgagttacatgatcccccatgttgtgcaaaaaa | | | |
| gcggttagctccttcggtcctccgatcgttgtcagaagtaa | | | |
| gttggccgcagtgttatcactcatggttatggcagcactgc | | | |
| ataattctcttactgtcatgccatccgtaagatgcttttct | | | |
| gtgactggtgagtactcaaccaagtcattctgagaatagtg | | | |
| tatgcggcgaccgagttgctcttgcccggcgtcaatacggg | | | |
| ataataccgcgccacatagcagaactttaaaagtgctcatc | | | |
| attggaaaacgttcttcggggcgaaaactctcaaggatctt | | | |
| accgctgttgagatccagttcgatgtaacccactcgtgcac | | | |
| ccaactgatcttcagcatcttttactttcaccagcgtttct | | | |
| gggtgagcaaaaacaggaaggcaaaatgccgcaaaaaaggg | | | |
| aataagggcgacacggaaatgttgaatactcatactcttcc | | | |
| tttttcaatattattgaagcatttatcagggttattgtctc | | | |
| atgagcggatacatatttgaatgtatttagaaaaataaaca | | | |
| aatagggggttccgcgcacatttccccgaaaagtgccacctg | | | |
| acgtctaagaaaccattattatcatgacattaacctataaa | | | |
| aataggcgtatcacgaggccctttcgtctcgcgcgtttcgg | | | |
| tgatgacggtgaaaacctctgacacatgcagctcccggaga | | | |
| cggtcacagcttgtctgtaagcggatgccgggagcagacaa | | | |
| gcccgtcagggcgcgtcagcgggtgttggcgggtgtcgggg | | | |
| ctggcttaactatgcggcatcagagcagattgtactgagag | | | |
| tgcaccatatgcggtgtgaaataccgcacagatgcgtaagg | | | |
| agaaaataccgcatcaggcgccattcgccattcaggctgcg | | | |
| caactgttgggaagggcgatcggtgcgggcctcttcgctat | | | |
| tacgccagctggcgaaaggggggatgtgctgcaaggcgatta | | | |
| agttgggtaacgccagggttttcccagtcacgacgttgtaa | | | |
| aacgacggccagtgccacgctctcccttatgcgactcctgc | | | |
| attaggaagcagcccagtagtaggttgaggccgttgagcac | | | |
| cgccgccgcaaggaatggtgcatgcaaggagatggcgccca | | | |
| acagtcccccggccacgggcctgccaccatacccacgccg | | | |
| aaacaagcgctcatgagcccgaagtggcgagcccgatcttc | | | |
| cccatcggtgatgtcggcgatataggcgccagcaaccgcac | | | |
| ctgtggcgccggtgatgccggccacgatgcgtccggcgtag | | | |
| aggcgatttaaagacaggatatcagtggtccaggctctagt | | | |
| tttgactcaacaatatcaccagctgaagcctatagagtacg | | | |
| agccatagataaaataaaagattttatttagtctccagaaa | | | |
| aaggggggaatgaaagaccccacctgtaggtttggcaagct | | | |
| agcttaagtaacgccatttgcaaggcatggaaaatacata | | | |
| actgagaatagagaagttcagatcaaggttaggaacagaga | | | |
| gacagcagaatatgggccaaacaggatatctgtggtaagca | | | |
| gttcctgccccggctcagggccaagaacagatggtcccag | | | |
| atgcggtcccgccctcagcagtttctagagaaccatcagat | | | |
| gtttccagggtgccccaaggacctgaaaatgaccctgtgcc | | | |
| ttatttgaactaaccaatcagttcgcttctcgcttctgttc | | | |
| gcgcgcttctgctccccgagctcaataaaagagcccacaac | | | |

TABLE 3-continued

SEQUENCES
Sequence Table

| Sequence | Seq id no | Name | ID |
|---|---|---|---|
| ccctcactcggcgcgccagtcctccgatagactgcgtcgcc cgggtacccgtattcccaataaagcctcttgctgtttgcat ccgaatcgtggactcgctgatccttgggagggtctcctcag attgattgactgcccacctcggggtctttcatttggaggt tccaccgagatttggagacccctgcctagggaccaccgacc cccccgccgggaggtaagctggccagcggtcgtttcgtgtc tgtctctgtctttgtgcgtgttttgtgccggcatctaatgtt tgcgcctgcgtctgtactagttagctaactagctctgtatc tggcggacccgtggtggaactgacgagttcggaacacccgg ccgcaacccgggagacgtcccagggacttcgggggccgtt tttgtggcccgacctgagtccaaaaatcccgatcgttttgg actctttggtgcacccccctttagaggagggatatgtggttc tggtaggagacgagaacctaaaacagttcccgcctccgtct gaattttttgctttcggtttgggaccgaagccgcgccgcgcg tcttgtctgctgcagcatcgttctgtgttgtctctgtctga ctgtgtttctgtatttgtctgagaatatgggcccgggctag cctgttaccactcccttaagtttgaccttaggtcactggaa agatgtcgagcggatcgctcacaaccagtcggtagatgtca agaagagacgttgggttaccttctgctctgcagaatggca acctttaacgtcggatggccgcgagacggcaccttttaaccg agacctcatcacccaggttaagatcaaggtcttttcacctg gcccgcatggacacccagaccaggtcccctacatcgtgacc tgggaagccttggcttttgacccccctccctgggtcaagcc ctttgtacaccctaagcctccgcctcctcttcctccatccg ccccgtctctcccccttgaacctcctcgttcgacccccgcct cgatcctccctttatccagccctcactccttctctaggcgc cccccatatggccatatgagatcttatatgggggccaccccgc cccttgtaaacttccctgaccctgacatgacaagagttact aacagcccctctctccaagctcacttacaggctctctactt agtccagcacgaagtctggagacctctggcggcagcctacc aagaacaactggaccgaccggtggtacctcacccttaccga gtcggcgacacagtgtgggtccgccgacaccagactaagaa cctagaacctcgctggaaaggaccttacacagtcctgctga ccaccccaccgccctcaaagtagacggcatcgcagcttgg atacacgccgcccacgtgaaggctgccgaccccgggggtgg accatcctctagactgc | | | |
| AYHLENEVARLKKL | 105 | GCN4 epitope alanine mutant 1 | Amino Acid |
| AAHLENEVARLKKL | 106 | GCN4 epitope alanine mutant 2 | Amino Acid |
| AAALENEVARLKKL | 107 | GCN4 epitope alanine mutant 3 | Amino Acid |
| AAAAENEVARLKKL | 108 | GCN4 epitope alanine mutant 4 | Amino Acid |
| NYHLENEVARLKKA | 109 | GCN4 epitope alanine mutant 5 | Amino Acid |
| NYHLENEVARLKAA | 110 | GCN4 epitope alanine mutant 6 | Amino Acid |
| NYHLENEVARLAAA | 111 | GCN4 epitope alanine mutant 7 | Amino Acid |

TABLE 3-continued

SEQUENCES
Sequence Table

| Sequence | Seq id no | Name | ID |
|---|---|---|---|
| NYHLENEVARAAAA | 112 | GCN4 epitope alanine mutant 8 | Amino Acid |
| LLPKNYHLENEVARLKKL | 113 | GCN4 epitope extended 1 | Amino Acid |
| DLPQKYHLENEVARLKKL | 114 | GCN4 epitope extended 2 | Amino Acid |
| LVGEAAAKEAAAKA | 116 | Heavy chain linker HCNT3 | Amino Acid |
| AEAAAKEAAAKA | 117 | Heavy chain linker HCNT4 | Amino Acid |
| ggcggggcggaagt | 118 | NT1 Flex | |
| GGTGGGGAGGGAGCGGTGGAGGTGGTTCT | 119 | NT2 Flex2 | |
| AEAAAKEAAAKA | 120 | NT4 Rigid | Amino Acid |
| GCGGAAGCAGCCGCCAAAGAGGCTGCCGCGAAAGCG | 121 | NT4 Rigid | |
| GSAGSAAGSGEF | 122 | NT5: Flexible | Amino Acid |
| GGTTCCGCCGGTTCCGCAGCCGGCTCCGGAGAGTTC | 123 | NT5: Flexible | |
| KESGSVSSEQLAQFRSLD | 124 | NT7: Flexible, from scFv | Amino Acid |
| AAGGAATCCGGGAGCGTGTCTTCCGAACAGCTGGCTCAGTT CCGCAGCCTGGAT | 125 | NT7: Flexible, from scFv | |
| EGKSSGSGSESKST | 126 | NT8: Flexible from scFv | Amino Acid |
| GAGGGGAAGTCCTCCGGCTCTGGGTCCGAGTCCAAGTCCACA | 127 | NT8: Flexible from scFv | |
| APAPAPAPAPAPAP | 128 | NT9: Prolyl | |
| GCTCCCGCCCCTGCCCCAGCTCCTGCCCCCGCACCCGCACCC | 129 | NT9: Prolyl | |
| GG | 130 | NT10: Short | Amino Acid |
| ggcggg | 131 | NT10: Short | |
| GSTSGSGKPGSGEGSTKG | 132 | Whitlow peptide linker (scFv) | Amino Acid |
| GSTSGSGKPGSGEGSTKG | 133 | Cooper LIN (2003) in FMC63 CAR | Amino Acid |

TABLE 3-continued

| SEQUENCES Sequence Table | | | |
|---|---|---|---|
| Sequence | Seq id no | Name | ID |
| ASTKGPSVFPLAP | 134 | LL-Heavy | Amino Acid |
| TVAAPSVFIFPP | 135 | LL-Light | Amino Acid |
| ASTKGP | 136 | SS-Heavy | Amino Acid |
| TVAAP | 137 | SS-Light | Amino Acid |
| NYHLENEVARLKKL | 138 | GCN4 in LCNT1 | Amino Acid |
| LLPKNYHLENEVARLKKL | 139 | GCN4 in LCNT1-A | Amino Acid |
| DLPKQYHLENEVARLKKL | 140 | GCN4 in LCNT1-B | Amino Acid |
| LLPKNYHLENEVARLK | 141 | GCN4 in LCNT1-C | Amino Acid |
| LPKNYHLENEVARLK | 142 | GCN4 in LCNT1-D | Amino Acid |
| PKNYHLENEVARLK | 143 | GCN4 in LCNT1-E | Amino Acid |
| KNYHLENEVARLK | 144 | GCN4 in LCNT1-F | Amino Acid |
| NYHLENEVARLK | 145 | GCN4 in LCNT1-G | Amino Acid |
| NYHLENEVARLKA | 146 | GCN4 in LCNT1-H | Amino Acid |
| LLPKNYHLENEVARLKAL | 147 | GCN4 in LCNT1-I | Amino Acid |
| KNYHLENEVARLKAL | 148 | GCN4 in LCNT1-J | Amino Acid |
| NYHLENEVARLKAL | 149 | GCN4 in LCNT1-K | Amino Acid |
| NYHLENEVARLKGL | 150 | GCN4 in LCNT1-L | Amino Acid |
| NYHLENEVARLKAA | 151 | GCN4 in LCNT1-M | Amino Acid |
| KNYHLENEVARLKGL | 152 | GCN4 in LCNT1-N | Amino Acid |
| KNYHLENEVARLKAA | 153 | GCN4 in LCNT1-O | Amino Acid |
| KNYHLENEVARLKKL | 154 | GCN4 variant | Amino Acid |
| KNYHLENEVARLKAL | 155 | GCN4 variant | Amino Acid |
| KNYHLENEVARLKGL | 156 | GCN4 variant | Amino Acid |
| KNYHLENEVARLKAA | 157 | GCN4 variant | Amino Acid |
| KNYHLENEVARLKGG | 158 | GCN4 variant | Amino Acid |

TABLE 3-continued

SEQUENCES
Sequence Table

| Sequence | Seq id no | Name | ID |
|---|---|---|---|
| NYHLENEVARLKKL | 159 | GCN4 variant | Amino Acid |
| NYHLENEVARLKAL | 160 | GCN4 variant | Amino Acid |
| NYHLENEVARLKGL | 161 | GCN4 variant | Amino Acid |
| NYHLENEVARLKAA | 162 | GCN4 variant | Amino Acid |
| NYHLENEVARLKGG | 163 | GCN4 variant | Amino Acid |
| EAAAKEAAAKEAAAKA | 164 | rigid linker | Amino Acid |
| TTTPAPRPPTPAPTIASQPLSLRPEACRPAAGGAVHTRGLDFACD | 165 | CD8 Hinge | Amino Acid |
| D | 166 |  | Amino Acid |
| ESKYGPPCPSCP | 167 | IgG4 Hinge | Amino Acid |
| ESKYGPPCPPCP | 168 | IgG4m Hinge | Amino Acid |
| X1NYHLENEVARLKX2X3 | 269 | Structure I | Amino Acid |
| IEVMYPPPYLDNEKSNGTIIHVKGKHLCPSPLFPGPSKP | 421 | CD28 Hinge | Amino Acid |

EXAMPLES

Example 1

Design of Humanized CAR-EC Switches

Background:

The anti-CD19 murine clone FMC63 was used as proof of concept in preliminary studies as a switch for the switchable CAR-EC program. The FMC63 clone was originally described in 1991 by H. Zola and coworkers (1) and is used in the most well studied conventional CAR-T cell from Carl June and coworkers (2-4). To decrease the potential for immunogenicity in human application, the murine framework regions of the FMC63 antibody were partially replaced with human sequences.

General Process:

Briefly, the humanization process was carried out as follows: The murine FMC63 sequences for variable light (VL) and variable heavy (VH) domains were submitted to the IgBLAST program available on the NCBI website at the world wide web address: ncbi.nlm.nih.gov/igblast/ (incorporated herein by reference in its entirety); see, also, Ye, et al., Nucleic Acids Res. 2013 July; 41(Web Server issue), incorporated herein by reference in its entirety. Each murine sequence was compared to murine germline sequences and then compared to human germline sequences.

Heavy Chain Analysis

Murine FMC63 VH was aligned with human germline IGHV4-59 (Table 4). The complimentary determining regions (CDR) are generally defined using AbYsis from AbM (available at the world wide web address bioinf.org.uk/abs/, incorporated herein by reference in its entirety); AbM numbering will be used in this report. Of the numerous framework differences between murine FMC VH and human IGHV4-59, we identified nine that may influence the conformation of the VH domain and its CDRs and that we decided to investigate for potential impact.

Design hFMCH2 (Table 4) has a complete human IGHV4-59 ("h4-59_01") framework with seven alterations—murine residues at positons 20, 48, 67, 71, 78, 82, and 82c.

Design hFMCH3 (Table 4) has Thr73 changed to mouse Asn73 in addition to all the changes in hFMCH2.

An additional change at position 94 was also investigated: Design hFMCH4a has the position 94 change in addition to all changes included in hFMCH2; design hFMCH4b has the position 94 change in addition to all changes included in hFMCH3.

Figure 1B:
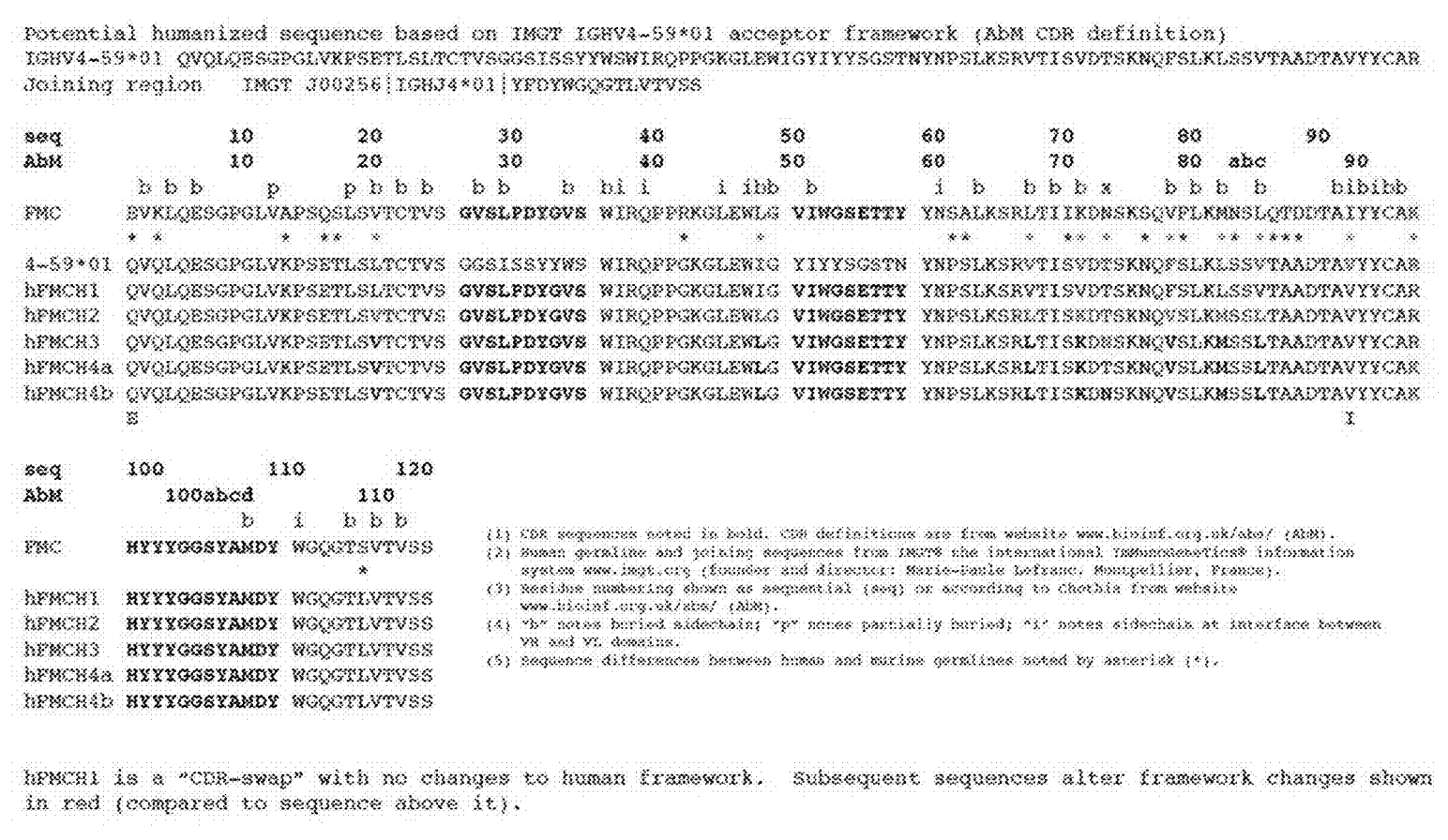

In addition, the N-terminal residue was mutated to Glu instead of Gln in various constructs as this removes pyroGln formation. Alignments of the Heavy Chain sequences of various exemplary constructs are provided in FIG. 1A and FIG. 1B.

TABLE 4

Heavy Chain Sequences (see also, FIG. 1A and FIG. 1B)

| SEQ ID NO | NAME | SEQUENCE |
|---|---|---|
| 1 | h4-59_01 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAR |
| 2 | hFMCH1 | QVQLQESGPGLVKPSETLSLTCTVSGVSLPDYGVSWIRQPPGKGLEWIGVIWGSETTYYNPSLKSRVTISVDTSKNQFSLKLSSVTAADTAVYYCARHYYYGGSYAMDYWGQGTLVTVSS |
| 3 | hFMCH2 | QVQLQESGPGLVKPSETLSVTCTVSGVSLPDYGVSWIRQPPGKGLEWLGVIWGSETTYYNPSLKSRLTISKDTSKNQVSLKMSSLTAADTAVYYCARHYYYGGSYAMDYWGQGTLVTVSS |
| 4 | hFMCH3 | QVQLQESGPGLVKPSETLSVTCTVSGVSLPDYGVSWIRQPPGKGLEWLGVIWGSETTYYNPSLKSRLTISKDNSKNQVSLKMSSLTAADTAVYYCARHYYYGGSYAMDYWGQGTLVTVSS |
| 5 | hFMCH4a | QVQLQESGPGLVKPSETLSVTCTVSGVSLPDYGVSWIRQPPGKGLEWLGVIWGSETTYYNPSLKSRLTISKDTSKNQVSLKMSSLTAADTAVYYCAKHYYYGGSYAMDYWGQGTLVTVSS |
| 6 | hFMCH4b | QVQLQESGPGLVKPSETLSVTCTVSGVSLPDYGVSWIRQPPGKGLEWLGVIWGSETTYYNPSLKSRLTISKDNSKNQVSLKMSSLTAADTAVYYCAKHYYYGGSYAMDYWGQGTLVTVSS |
| 7 | hFMCH4c | QVQLQESGPGLVKPSETLSVTCTVSGVSLPDYGVSWIRQPPGKGLEWLGVIWGSETTYYNSALKSRLTISKDNSKNQVSLKMSSLTAADTAVYYCAKHYYYGGSYAMDYWGQGTLVTVSS |
| 8 | hFMCH4z | QVQLQESGPGLVKPSETLSVTCTVSGVSLPDYGVSWIRQPPGKGLEWLGVIWGSETTYYNSSLKSRLTISKDNSKNQVSLKMSSLTAADTAVYYCAKHYYYGGSYAMDYWGQGTLVTVSS |
| 9 | hFMCH4b-x | QVQLQESGPGLVKPSETLSLTCTVSGVSLPDYGVSWIRQPPGKGLEWIGVIWGSETTYYNPSLKSRVTISKDNSKNQFSLKLSSVTAADTAVYYCAKHYYYGGSYAMDYWGQGTLVTVSS |
| 10 | hFMCH4c-x | QVQLQESGPGLVKPSETLSLTCTVSGVSLPDYGVSWIRQPPGKGLEWIGVIWGSETTYYNSALKSRVTISKDNSKNQFSLKLSSVTAADTAVYYCAKHYYYGGSYAMDYWGQGTLVTVSS |
| 11 | hFMCH4c-20L-E | EVQLQESGPGLVKPSETLSLTCTVSGVSLPDYGVSWIRQPPGKGLEWLGVIWGSETTYYNSALKSRLTISKDNSKNQVSLKMSSLTAADTAVYYCAKHYYYGGSYAMDYWGQGTLVTVSS |
| 12 | hFMCH4b-E | EVQLQESGPGLVKPSSETLSVTCTVSGVSLPDYGVSWIRQPPGKGLEWLGVIWGSETTYYNPSLKSRLTISKDNSKNQVSLKMSSLTAADTAVYYCAKHYYYGGSYAMDYWGQGTLVTVSS |
| 13 | hFMCH4c-E | EVQLQESGPGLVKPSSETLSVTCTVSGVSLPDYGVSWIRQPPGKGLEWLGVIWGSETTYYNSALKSRLTISKDNSKNQVSLKMSSLTAADTAVYYCAKHYYYGGSYAMDYWGQGTLVTVSS |
| 14 | hFMCH4b-20L-E | EVQLQESGPGLVKPSETLSLTCTVSGVSLPDYGVSWIRQPPGKGLEWLGVIWGSETTYYNPSLKSRLTISKDNSKNQVSLKMSSLTAADTAVYYCAKHYYYGGSYAMDYWGQGTLVTVSS |
| 15 | mFMC63H | EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS |

Light Chain Analysis

Murine FMC VL was aligned with human germline IGKV1-39 (Table 5). CDR definitions used are those from AbM (available at the world wide web address bioinf.org.uk/abs/, incorporated herein by reference in its entirety). Of the numerous framework differences between murine FMC VL and human IGKV1-39, only position 71 likely would influence the conformation of the VL domain and its CDRs.

Design hFMCL2 includes the Phe71Tyr change.

FMC CDR-L3 has an Asn residue (Asn92) that has low propensity for deamidation, therefore this residue could be changed to alanine. Alignments of the Light Chain sequences are provided in FIG. 2A and FIG. 2B.

TABLE 5

Figure 2B:
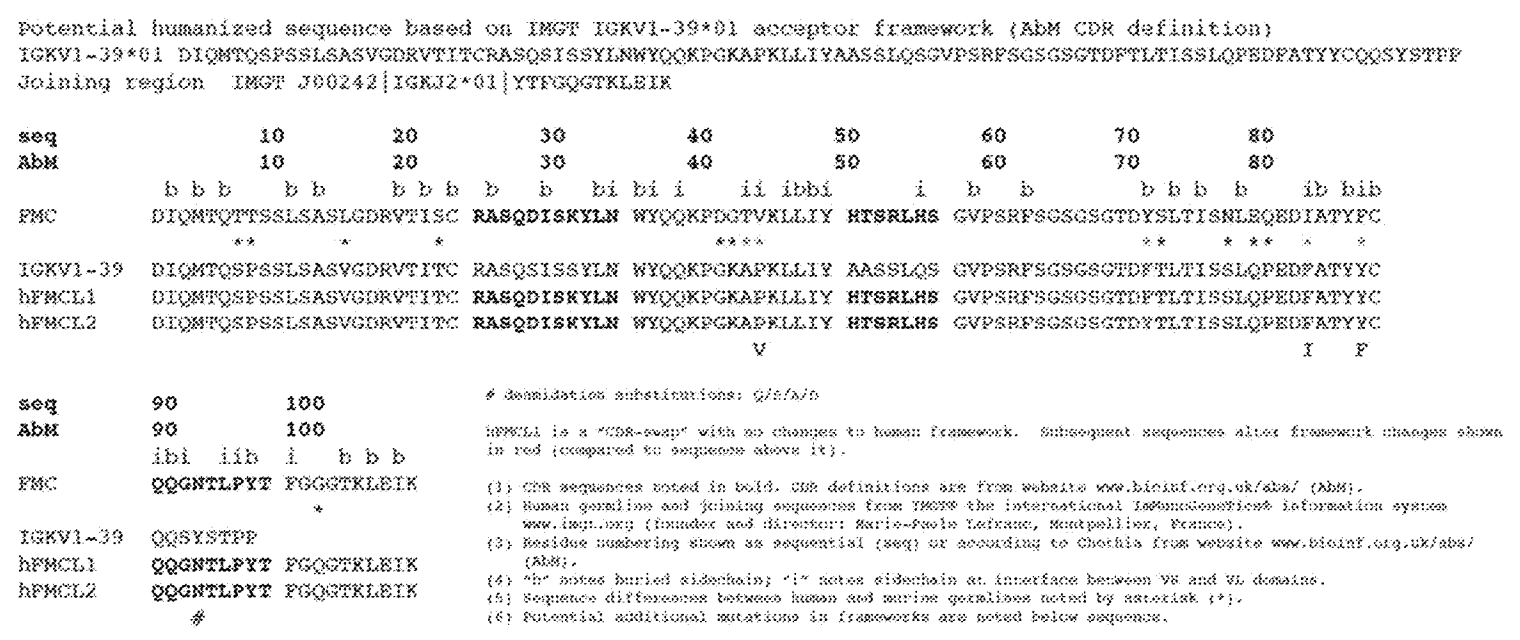

Light Chain Sequences (see also, FIG. 2A and FIG. 2B)

| SEQ ID NO | NAME | SEQUENCE |
|---|---|---|
| 16 | IGKV1-39 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPP |
| 17 | hFMCL1 | DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKLEIK |
| 18 | hFMCL2 | DIQMTQSPSSLSASVGDRVTITCRASQDISKYLNWYQQKPGKAPKLLIYHTSRLHSGVPSRFSGSGSGTDYTLTISSLQPEDFATYYCQQGATLPYTFGQGTKLEIK |
| 19 | hFMCL2a | DIQMTQSPSSLSASVGDRVTITCRASQDISKYLNWYQQKPGKAVKLLIYHTSRLHSGVPSRFSGSGSGTDYTLTISSLQPEDFATYYCQQGATLPYTFGQGTKLEIK |
| 20 | hFMCL2b | DIQMTQSPSSLSASVGDRVTITCRASQDISKYLNWYQQKPGKAVKLLIYHTSRLHSGVPSRFSGSGSGTDYTLTISSLQPEDFATYFCQQGATLPYTFGQGTKLEIK |
| 21 | hFMCL2b-1 | DIQMTQSPSSLSASVGDRVTITCRASQDISKYLNWYQQKPGKAPKLLIYHTSRLHSGVPSRFSGSGSGTDYTLTISSLQPEDFATYFCQQGATLPYTFGQGTKLEIK |
| 22 | hFMCL2b(V44L) | DIQMTQSPSSLSASVGDRVTITCRASQDISKYLNWYQQKPGKALKLLIYHTSRLHSGVPSRFSGSGSGTDYTLTISSLQPEDFATYFCQQGATLPYTFGQGTKLEIK |
| 23 | hFMCL2b(A92N) | DIQMTQSPSSLSASVGDRVTITCRASQDISKYLNWYQQKPGKAVKLLIYHTSRLHSGVPSRFSGSGSGTDYTLTISSLQPEDFATYFCQQGNTLPYTFGQGTKLEIK |
| 24 | hFMCL2c | DIQMTQSPSSLSASVGDRVTITCRASQDISKYLNWYQQKPGKAVKLLIYHTSRLHSGVPSRFSGSGSGTDYTLTISSLQPEDFATYFCQQGATLPYTFGQGTKLEIK |
| 25 | mFMC63L | DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIK |

Switch Production

CAR-EC switches containing the above humanized "FMC63 VH" and/or "FMC63 VL" sequences were produced by genetically fusing a GCN4 peptide to the N terminus of the light chain (LCNT) connected with a GGGGS linker as described in Rodgers D T, et al., PNAS, 2016; 113(4):E459-68. doi: 10.1073/pnas.1524155113. PubMed PMID: 26759369; PMCID: PMC4743815 (incorporated herein by reference in its entirety). In these non-limiting examples, a GCN4 peptide comprising the sequence NYHLENEVARLKKL (SEQ ID NO: 26) was used. Thus, the LCNT constructs comprised the following structure: NYHLENEVARLKKL-[GGGGS] (SEQ ID NO:435)-[FMC63 VL sequence or humanized variants thereof].

(5). Switches were expressed with one heavy chain and one light chain (e.g., FMC63 VL or a GNC4 peptide-fused LCNT variant) and purified to homogeneity as described in Example 2.

Table 6 shows 21 non-limiting examples of humanized CAR-EC switch variants. The heavy chain/light chain combinations used to make these switches are shown in the rows of Table 6. For example, the CAR-EC switch labeled below as combination 2 included the FMC63 humanized variable heavy chain H2 (i.e., hFMCH2 shown in FIG. 1A and FIG. 1B) and the humanized variable light chain L2 (i.e., hFMCL2 shown in FIG. 2A and FIG. 2B). As discussed above, all of the light chains included in the CAR-EC switches exemplified in this example further comprised the GCN4 peptide fusion at their N-terminus, linked by the GGGGS (SEQ ID NO: 93) linker. So, combination 2 comprised hFMCH2 and a tagged light chain having the general structure (from N-terminus to C-terminus or "N to C" for short) NYHLENEVARLKKL-[GGGGS] (SEQ ID NO:435)-[hFMCL2]; combination 3 comprised hFMCH3 and a tagged light chain having the general structure N to C NYHLENEVARLKKL-[GGGGS] (SEQ ID NO:435)-[hFMCL2]; combination 7 comprised hFMCH4b and a tagged light chain having the general structure NYHLENEVARLKKL-[GGGGS] (SEQ ID NO:435)-[hFMCL2b]; and so on. These light chain N-terminal (LCNT) switch sequences are listed below in Table 7.

TABLE 6

Humanized FMC63 variants

| HC/LC combination | Round 1 | Heavy chain | Light chain | Notes |
|---|---|---|---|---|
| 1 | human | H1 (N/A) | L1 (N/A) | fully human frameworks (not expressed) |
| 2 | | H2 | L2 | |
| 3 | | H3 | L2 | |
| 4 | | H4a | L2 | |
| 5 | | H4b | L2 | |
| 6 | Round 2 | H4b | L2a | |

TABLE 6-continued

Humanized FMC63 variants

| HC/LC combination | Round 1 | Heavy chain | Light chain | Notes |
|---|---|---|---|---|
| 7 | | H4b | L2b | |
| 8 | | H4b | L2c | |
| 9 | | H4c | L2a | |
| 10 | | H4c | L2b | |
| 22 | | H4c | L2c | |
| 11 | | H4z | L2 | |
| 12 | | H4c-E | L2b | Gln-Glu mutation on N-terminus heavy chain |
| 13 | | H4c-kappa | L2b | kappa chain leader sequence |
| 14 | Round 3 | H4c-E | L2b | |
| 15 | | H4b-E | L2b | |
| 16 | | H4b-x-E | L2b | |
| 17 | | H4c-x-E | L2b | |
| 18 | | H4b-20L-E | L2b | |
| 19 | | H4c-20L-E | L2b | |
| 20 | | H4c-E | L2b-44L | |
| 21 | | H4c-E | L2b-A92N | |

In Table "E" notes that the N-terminal glutamine was mutated to glutamate to avoid formation of the pyroglutamate N-terminal residue.

Example 2

Expression and Purification of Humanized CAR-EC Switches

Briefly, to express and purify humanized CAR-EC Switches, one heavy chain variant, as described in Table 4, was paired with one light chain variant, as described in Table 5, according to the schematic shown in Table 6, wherein the light chain comprised the GCN4 peptide linked via the GGGGS (SEQ ID NO:93) linker in the LCNT format, as shown in Table 7, and the resulting switch was expressed and purified according to the following protein expression method.

Protein Expression in Expi293F™ Cells (30 ml Culture Volume)

Transfections of Expi293F™ cells (ThermoFisher, Waltham, MA, Catalog Number A14527) were carried out using a modified version of the manufacturer's protocol provided with the ExpiFectamine 293 Transfection™ kit (ThermoFisher, Waltham, MA, Catalog Number A14524).

Briefly, 24 hours prior to transfection, Expi293F™ cells (ThermoFisher, Waltham, MA, Catalog Number A14527)

TABLE 7

LCNT Light Chain Sequences

| SEQ ID NO | NAME | SEQUENCE |
|---|---|---|
| 27 | hFMCL1-LCNT | NYHLENEVARLKKLGGGGSDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKLEIK |
| 28 | hFMCL2-LCNT | NYHLENEVARLKKLGGGGSDIQMTQSPSSLSASVGDRVTITCRASQDISKYLNWYQQKPGKAPKLLIYHTSRLHSGVPSRFSGSGSGTDYTLTISSLQPEDFATYYCQQGATLPYTFGQGTKLEIK |
| 29 | hFMCL2a-LCNT | NYHLENEVARLKKLGGGGSDIQMTQSPSSLSASVGDRVTITCRASQDISKYLNWYQQKPSGKAVKLLIYHTSRLHSGVPSRFSGSGSGTDYTLTISSLQPEDFATYYCQQGATLPYTFGQGTKLEIK |
| 30 | hFMCL2b-LCNT | NYHLENEVARLKKLGGGGSDIQMTQSPSSLSASVGDRVTITCRASQDISKYLNWYQQKPSGKAVKLLIYHTSRLHSGVPSRFSGSGSGTDYTLTISSLQPEDFATYFCQQGATLPYTFGQGTKLEIK |
| 31 | hFMCL2b-1-LCNT | NYHLENEVARLKKLGGGGSDIQMTQSPSSLSASVGDRVTITCRASQDISKYLNWYQQKPSGKAPKLLIYHTSRLHSGVPSRFSGSGSGTDYTLTISSLQPEDFATYFCQQGATLPYTFGQGTKLEIK |
| 32 | hFMCL2b(V44L)-LCNT | NYHLENEVARLKKLGGGGSDIQMTQSPSSLSASVGDRVTITCRASQDISKYLNWYQQKPSGKALKLLIYHTSRLHSGVPSRFSGSGSGTDYTLTISSLQPEDFATYFCQQGATLPYTFGQGTKLEIK |
| 33 | hFMCL2b(A92N)-LCNT | NYHLENEVARLKKLGGGGSDIQMTQSPSSLSASVGDRVTITCRASQDISKYLNWYQQKPSGKAVKLLIYHTSRLHSGVPSRFSGSGSGTDYTLTISSLQPEDFATYFCQQGNTLPYTFGQGTKLEIK |
| 34 | hFMCL2c-LCNT | NYHLENEVARLKKLGGGGSDIQMTQSPSSLSASVGDRVTITCRASQDISKYLNWYQQKPSGKAVKLLIYHTSRLHSGVPSRFSGSGSGTDYTLTISSLQPEDFATYFCQQGATLPYTFGQGTKLEIK |
| 35 | mFMC63-LCNT | NYHLENEVARLKKLGGGGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIK | were seeded at 1.5×10⁶ cells/ml in pre-warmed Expi293 Expression Media™ (ThermoFisher, Waltham, MA, Catalog Number A1435101). On the day of transfection, cells were counted, checked for viability, and then diluted in pre-warmed Expi293 Expression Media™ to a final density equal to $2.9 \times 10^6$ cells/ml. The flask was returned to the orbital shaker in 37° C./5% CO2 incubator for a minimum of 1 h.

Transfections with DNA encoding the CAR-EC switch proteins were performed with a 1:1 heavy-to-light chain ratio (15 µg of DNA for each chain). DNA was diluted in OptiMEM I™ reduced serum medium to a final volume of 1.5 ml. 80 µl ExpiFectamine was diluted in 1.5 ml OptiMEM I™ reduced serum medium and incubated 5 min at room temperature. The ExpiFectamine/OptiMEM™ I mix was added to the tube containing DNA, and then mixed gently with a pipette and incubated 20 min at room temperature. The Expi293F™ cells were removed from the 37° C./5% CO2 incubator and 3 ml of the DNA/ExpiFectamine™ mixture was added to the cells and incubated on an orbital shaker at ~120 rpm in a 37° C./5% CO2 incubator. 16-18 h post-transfection, 150 µl of Enhancer 1 and 1.5 ml Enhancer 2 (provided in the ExpiFectamine 293 Transfection Kit™) was added to each well. The final volume was approximately 30 ml. Finally, 72 hr post-transfection, cells were harvested and switches were purified according to the protocol described below.

Protein G Purification (0.6 ml Settled Bed Volume)

72 hr post-transfection, the 30 ml cell cultures containing the CAR-EC switches were harvested, and cells/media were transfer to a 50 ml conical tube and spun 5 minutes at 400×g (~1,000 rpm), sterile filtered, and mixed with ¼₀th volume (0.75 ml) of 20× Protein G Binding Buffer (1M sodium acetate) pH 5.2 to lower the pH of the crude CAR-EC switch solutions for optimal binding to Protein G Sepharose™.

A 50% slurry of Protein G Fast Flow Sepharose™ (GE Healthcare, Product Code 17-0618-01) was prepared in 1× Protein G Binding Buffer, and 1.2 ml of the 50% slurry was added to a 12 ml Poly Prep™ chromatography column and then washed with 6 ml of 1× Protein G Binding Buffer. Supernatant containing expressed CAR-FC switch protein was passed over the column, and flow-through was collected in 50 ml conical tubes. The column was washed with 12 ml (20 CV) 1× Protein G Binding Buffer, and then CAR-EC switch proteins were eluted in 1.8 ml 100 mM glycine pH 2.8, and then 0.2 ml 1M TRIS®-HCl pH 8 was added to the eluates to neutralize the pH.

Following elution, 1×PBS pH 7.4 was added to elution fractions to yield a final volume equal to 2.5 ml. Buffer was exchanged into 1×PBS pH 7.4 using PD10 desalting columns as follows: PD10 columns were equilibrated with 25 ml 1×PBS PH 7.4. 2.5 ml of the purified protein solution was added to PD10 column. Protein was eluted from PD10 desalting column in 3.5 ml 1×PBS pH 7.4 and protein fractions were concentrated to approximately 0.200 ml in 4 ml 10K cutoff Amicon spin concentrators.

Figure 3:
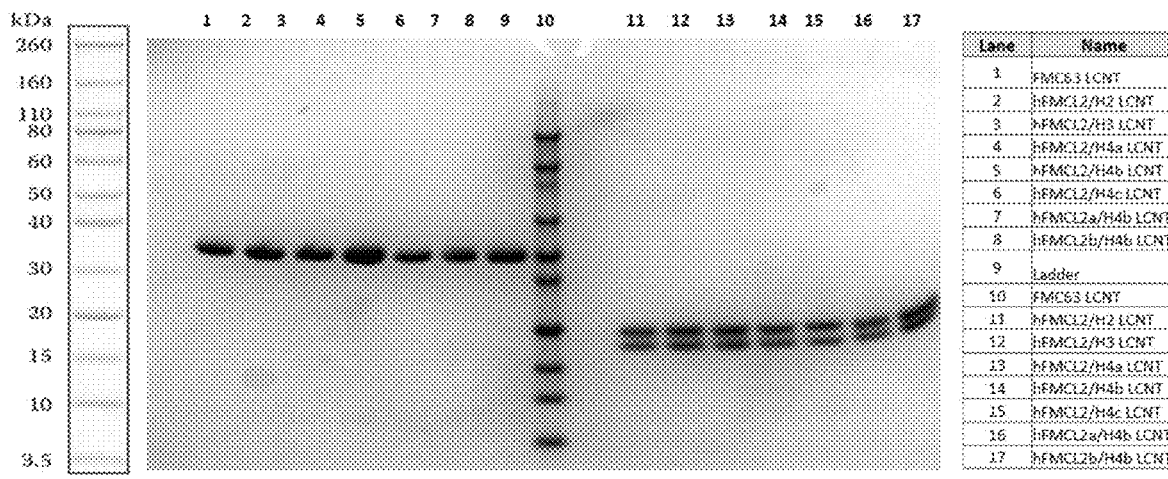
FIG. 3: shows an SDS PAGE gel, depicting the huFMC CAR-EC switches expressed in the LCNT switch format. The left side of the gel is not reduced. The right side of the gel is reduced with DTT.
Figure 4:
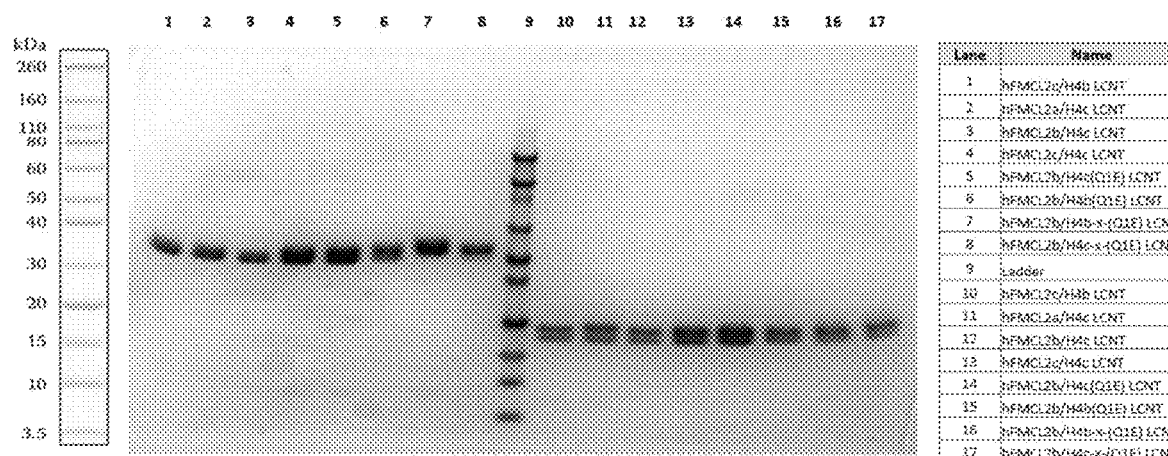
FIG. 4: shows SDS PAGE gel, depicting the huFMC CAR-EC switches expressed in the LCNT switch format. The left side of the gel is not reduced. The right side of the gel is reduced with DTT.
Figure 5:
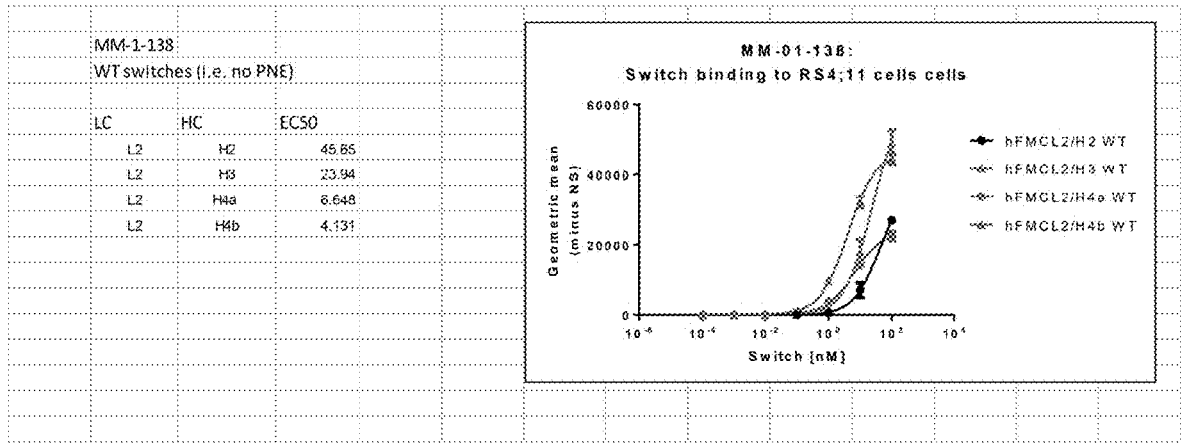
FIG. 5: shows flow cytometry-based binding assay of huFMC63 Fabs on CD19+ RS4;11 cells. $EC_{50}$ listed in nM (nanomolar).
Figure 6:
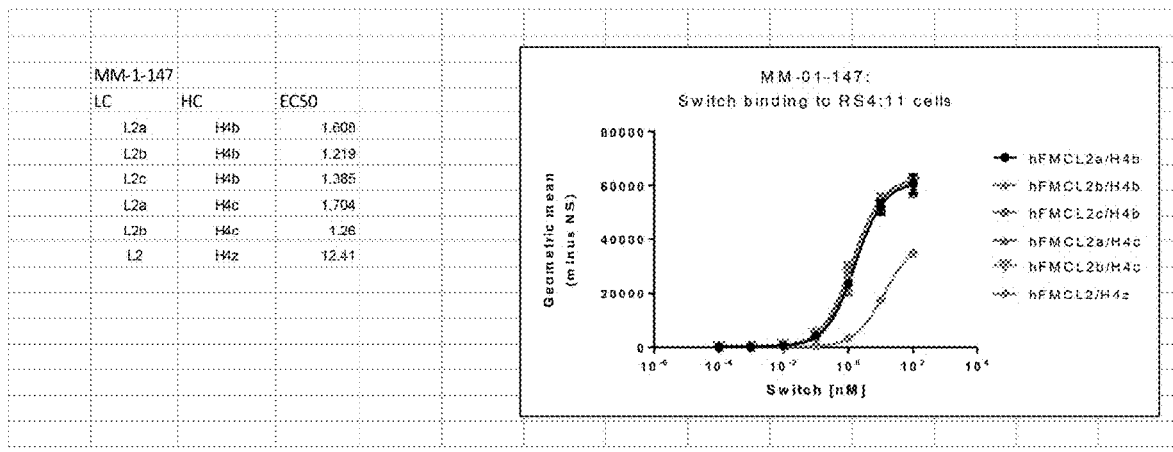
FIG. 6: shows flow cytometry-based binding assay of huFMC63 Fabs on CD19+ RS4;11 cells. $EC_{50}$ listed in nM (nanomolar).
Figure 7:
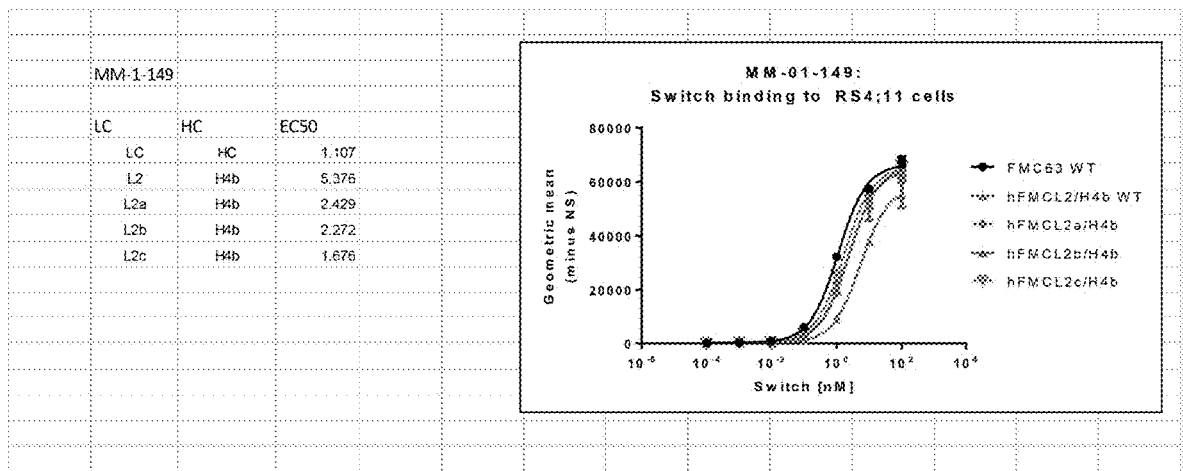
FIG. 7: shows flow cytometry-based binding assay of huFMC63 Fabs on CD19+ RS4;11 cells. FMC63 WT signifies chimeric FMC63 Fab (annotated as LC, HC in $EC_{50}$ table). $EC_{50}$ listed in nM (nanomolar).
Figure 8:
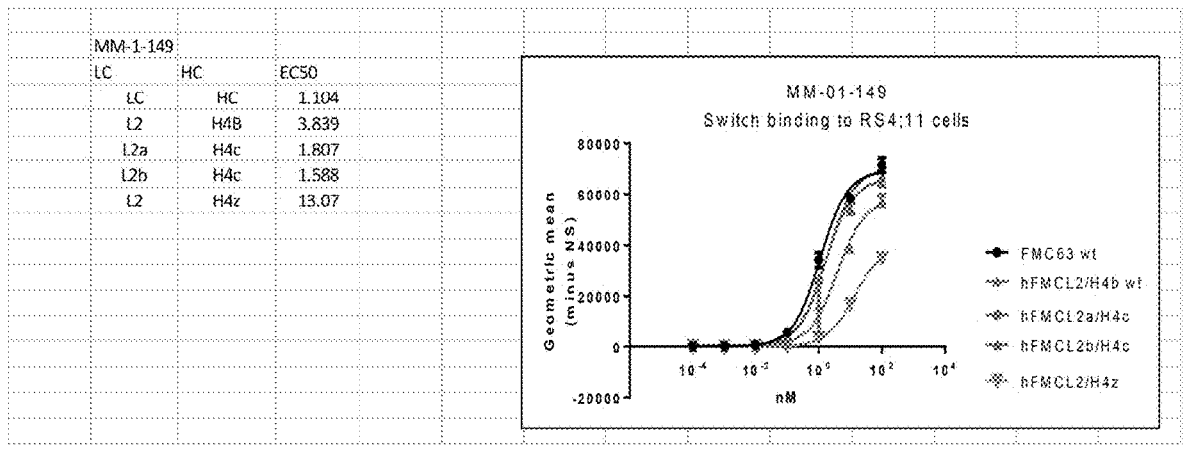
FIG. 8: shows flow cytometry-based binding assay of huFMC63 Fabs on CD19+ RS4;11 cells. FMC63 wt signifies chimeric FMC63 Fab (annotated as LC, HC in $EC_{50}$ table). $EC_{50}$ listed in nM (nanomolar).
Figure 9:
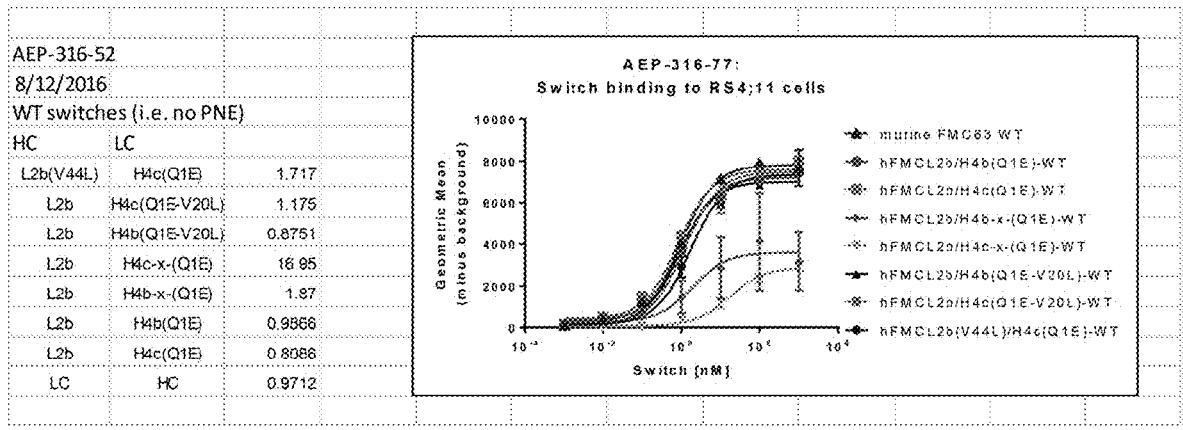
FIG. 9: shows flow cytometry-based binding assay of huFMC63 Fabs on CD19+ RS4;11 cells. FMC63 wt signifies chimeric FMC63 Fab (annotated as LC, HC in $EC_{50}$ table). $EC_{50}$ listed in nM (nanomolar)

Protein concentration was measured by NanoDrop™ (Thermo Scientific, Waltham, MA) according to the manufacturer's protocol, and then 2 µg of protein was visualized by SDS-PAGE on a 4-12% Bis-TRIS® gradient gel. FIG. 3 and FIG. 4 show photographs of the gels with 2 µg protein loaded in each lane, and analyzed in two conditions: non-reduced (left side) and reduced by the addition of 10 mM DTT (right side).

All of the humanized CAR-EC switch variants expressed well.

Example 3

Determination of CAR-EC Switch Binding Efficiency

To determine the relative binding efficiency of humanized variants, flow cytometry based binding was carried out as follows:

Preparation of Cells for Flow Cytometry Analysis of CAR-EC Switch Binding Efficiency.

CD19+RS4;11 cells (ATCC® CRL-1873TM) were harvested and centrifuged at 300×g for 5 min at 4° C. and then cells were resuspended in ice cold FACs buffer (PBS, 5% fetal calf serum, 1 mM EDTA) at a concentration of $5 \times 10^6$ cells/mL. 100 µL of cell suspension was dispensed per well of a 96-well plate, and then the cells were washed using the following Wash Method: a) 200 µL of FACs buffer was added to each well of the plate; b) the plate was centrifuged at 300×g for 5 min at 4° C.; c) supernatant was removed from the plate by 'flick' motion into a sink; d) the cell pellets were loosened by gentle vortexing of the plate; and e) cells pellets were re-suspended in an appropriate volume of buffer (as described below).

For initial CAR-EC switch binding, the cell pellets from Wash Method step e) were each re-suspended with 50 µl of primary "test" CAR-EC switch protein diluted in FACS buffer. A range of CAR-EC switch concentrations were used to test binding, for example ranging from $10^{-1}$ to $10^3$ pM CAR-EC switch.

Cells were incubated with the CAR-EC switches at 4° C., in the dark, for 30 minutes, and then cells were washed 3 times using the Wash Method described above. Each cell pellet from Wash Method step e) was re-suspended with 50 µL of detection antibody diluted 1/100 in FACS buffer (Detection antibody was PE-conjugated goat anti-human Kappa: Southern Biotech, cat. #2060-09). Cells were incubated at 4'° C., in the dark, for 30 minutes, washed 3 times using the Wash Method described above, and then cell pellets from Wash Method step e) were re-suspended with 100 µL FACS buffer.

Data was acquired on a flow cytometer configured for a U-bottom 96-well plate, with a laser setting of 3 Blue 1 Red. Gates were established to identify cell population of interest, single cells and PE-positive cells, and 30,000 events were acquired.

Data Analysis

Flow cytometry data was analyzed using FlowJo Software V10 (FlowJo, LLC, Ashland, OR). Briefly, mean fluorescent intensity (MFI) of PE signal was obtained on all events, but we did not gate on PE positive cells. An XY table was created in GraphPad Prism (GraphPad Software, Inc., La Jolla, CA) and the data was input to plot PE MFI vs CAR-EC switch concentration. Data was transformed using the X=log function and then fit using the "log (agonist) vs response (three parameter)" function. FIG. 5, FIG. 6, FIG. 7, FIG. 8, and FIG. 9 show the data plots for the various tested CAR-EC switches. $EC_{50}$ values are shown next to the plots.

Example 4

Determination of CAR-EC Switch Efficacy for Inducing Target Cell Cytotoxicity

To determine the efficacy of the humanized FMC63 variants as switches for the switchable CAR-T cell platform, variants were expressed with the GCN4 peptide on the N terminus of the light chain (LCNT) connected with a GGGGS linker as described in Example 1, above, and switches were expressed and purified with one heavy and one light chain-LCNT variant and purified to homogeneity as described above in Examples 1 and 2.

The sCAR-T cell was constructed as previously described in Rodgers D T (2016), supra. The construct is briefly described as antiGCN4 scFv-IgG4m hinge-CD8 transmembrane domain-CD137 (aka 4-1BB) costimulatory domain-CD3z activation domain.

Cytotoxicity Assay Method

Cytotoxicity assays were carried out as follows. On Day 1, a 6-point serial dilution of the switches in cold RPMI-5 was prepared in a flat bottomed 96 well plate using 1 column for each switch. Optionally, switch plates were stored at 4° C. for 1 week, or snap frozen on dry ice and stored at −80° C. long term. Samples were run in duplicate or triplicate. Additionally, the following controls were included:
  i. Maximum kill—target cells only, which were lysed 45 min before the end of the assay to provide a value for the maximum LDH level/100% cytotoxicity. Maximum kill is also referred to as "maximum LDH value."
  ii. Spontaneous kill—target cells only, which act as a background target cell lysis.
  iii. Effector cells alone—this control indicates background LDH signal of effector cells, for use in diagnostics if assay doesn't work.
  iv. Effector and target cells alone—no switch control to determine background cytotoxicity as a result of co-culturing cells.
  v. Media alone—control for media for use in diagnostics if assay doesn't work, and for calculating cytotoxicity of conventional CAR-T cells.

Cells were centrifuged at 300×g for 5 minutes at room temperature, and seeded in pre-warmed RPMI-5 media at a concentration of $2\times10^6$/mL for the CAR effector cells and at $2\times10^5$/mL for the target cells. Target and CAR effector cells had >95% viability to reduce background. For standard assays, 100,000 effector cells (E) and 10,000 target cells (T) were used, giving an E:T ratio of 10:1. Assays used 50 μL of effector cells and 50 μL of target cells in each well, and then the wells were topped off with media to ensure equal volume in all wells. Finally, 2 μL of the CAR-EC switch dilutions were added to the relevant wells and then the plates were incubated for 20-24 hours.

LDH Assay Method: Day 2, Running the LDH Assay:

LDH assays were carried out using the CytoTox 96® Non-Radioactive Cytotoxicity Assay (Promega, G1780) according to the manufacturer's protocol. All buffers and reagents listed below in this assay are components of this CytoTox 96® kit. Briefly, on Day 2, 45 minutes before the end of the assay, 10 μL of 10× lysis buffer was added to the 'Maximum Kill' control wells, and the cells were manually lysed by multiple pipetting actions.

LDH master mix was prepared by adding 12 mL of assay buffer thawed in a 37° C. water bath to 1 vial of LDH assay working reagent. After the 45 minute incubation of the Maximum Kill control wells with the lysis buffer, the plate was centrifuged at 400×g for 5 minutes and 30 μL of the supernatants were transferred to identical wells in a new 96 well plate (flat bottomed). 30 μL of LDH working reagent was added to each well and incubated for 30 minutes at room temperature in the dark. Then, 30 μL of the Stop Solution was added to each well and the absorbance was read at OD495 and data was exported as .txt or .xlsx files.

LDH Assay Data Analysis:

Raw data was transferred into Microsoft Excel and a 100% cytotoxicity value for the assay was calculated using the following formula: OD Maximum kill minus OD Spontaneous kill.

The 'Effector and Target cells alone' value (i.e., OD495 reading) was subtracted from all sample values.

Percent cytotoxicity was calculated using the following formula:

$$100\times(\text{Sample OD495/max LDH value})$$

Values were plotted in GraphPad Prism. Data was transformed using the X=log function and $EC_{50}$ values were calculated using the "log (agonist) vs response (three parameter)" fit function.

Figure 10:
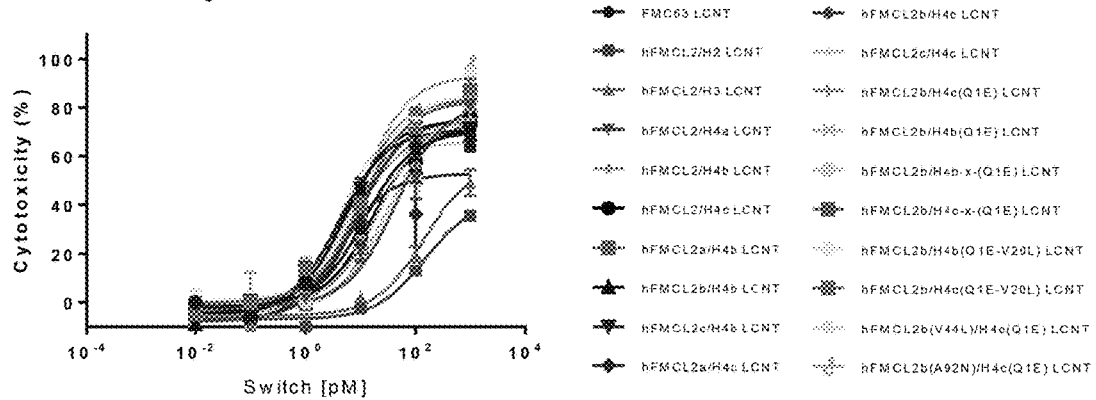
FIG. 10: shows cytotoxicity of huFMC63-based switches with switchable CAR-T (sCAR-T) cells against CD19+ RS4;11 cells. $EC_{50}$ values for this experiment are listed in Table 8 along with 3 repeats of this experiment. 80% CAR+ indicates 80% of the T cell population used in this assay was positive for the switchable CAR. FMC63 LCNT signifies chimeric FMC63 Fab with GCN4 peptide on the N terminus of the light chain.
Figure 11:
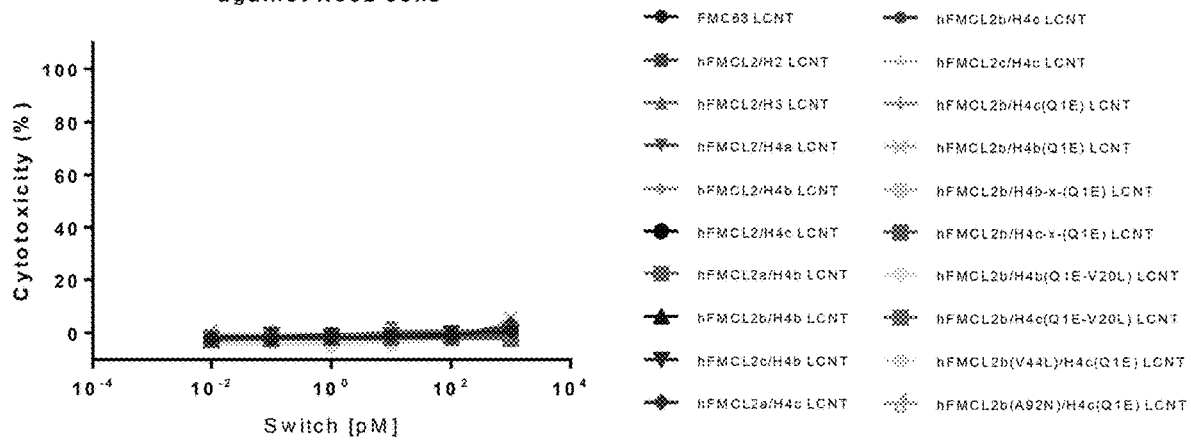
FIG. 11: shows cytotoxicity of huFMC63-based switches with switchable CAR-T cells against CD19− K562 cells. No $EC_{50}$ values were calculated from cytotoxicity on K562 due to the low levels of cytotoxicity found. 80% CAR+ indicates 80% of the T cell population used in this assay was positive for the switchable CAR. FMC63 LCNT signifies chimeric FMC63 Fab with GCN4 peptide on the N terminus of the light chain.

LDH Cytotoxicity Assay Results:

LDH cytotoxicity assay results are shown in FIGS. 10-11. Specifically, FIG. 10 shows LDH cytotoxicity of sCAR-EC cells (e.g., sCAR-T cells) against RS4; 11 cells, which are CD19-positive, and FIG. 11 shows LDH cytotoxicity of sCAR-EC cells (e.g., sCAR-T cells) against K562 cells, which are CD19-negative. In both cases, the sCAR-EC cells (e.g., sCAR-T cells) were 80% positive for the expression of the switchable CAR, and the cells were treated with one of the various humanized CAR-EC switch variants listed in the legend.

Strong dose-dependent induction of CD19-positive RS4; 11 cell cytotoxicity was observed by treatment with the sCAR/humanized switch combination (FIG. 10, Table 8). Table 8 shows the $EC_{50}$ values for the LDH cytotoxicity assay with various humanized switches repeated over 4 assays. The assays are numbered DTR-5-15 (shown in FIG. 10), DTR-5-16, DTR-5-50, DTR-5-51. Assays in which cells are labeled PBMC are switchable CAR-T cells derived from transduction of unsorted PBMCs, and assays in which the cells are labeled CD4: CD8 are switchable CAR-T cells derived from sorted CD4 and CD8 T cells, transduced, and used in equal ratios in the cytotoxicity assay. muFMC63 LCNT indicates the murine FMC63-based switch.

TABLE 8

$EC_{50}$ values for cytotoxicity assay with humanized switches (4 repeat assays).

| Switch | $EC_{50}$ (pM) | | | | |
|---|---|---|---|---|---|
| | DTR-5-15 | DTR-5-16 | DTR-5-50 | DTR-5-51 | Average |
| hFMCL2c-LCNT/hFMCH4c | 4.57 | 4.61 | 3.78 | 5.45 | 4.60 |
| muFMC63 LCNT (Batch P00958) | | 6.81 | 2.77 | 5.31 | 4.96 |
| hFMCL2c-LCNT/hFMCH4b | 4.04 | 3.25 | 3.78 | 9.65 | 5.18 |
| hFMCL2b-LCNT/hFMCH4b | 5.17 | 5.78 | 3.93 | 9.96 | 6.21 |
| hFMCL2a-LCNT/hFMCH4b | 10.41 | 6.03 | 5.29 | 5.45 | 6.80 |
| hFMCL2b(V44L)-LCNT/ hFMCH4c(Q1E) | 2.04 | 8.45 | 7.01 | 12.32 | 7.45 |

TABLE 8-continued

EC$_{50}$ values for cytotoxicity assay with humanized switches (4 repeat assays).

| Switch | EC$_{50}$ (pM) | | | | |
| --- | --- | --- | --- | --- | --- |
| | DTR-5-15 | DTR-5-16 | DTR-5-50 | DTR-5-51 | Average |
| hFMCL2a-LCNT/hFMCH4c | 4.43 | 9.32 | 7.05 | 17.19 | 9.50 |
| hFMCL2b-LCNT/ hFMCH4c(Q1E) | 7.10 | 9.41 | 8.25 | 13.28 | 9.51 |
| hFMCL2b(A92N)-LCNT/ hFMCH4c(Q1E) | 8.73 | 9.19 | 6.55 | 15.21 | 9.92 |
| hFMCL2b-LCNT/ hFMCH4b(Q1E-V20L) | 9.63 | 13.12 | 7.48 | 9.60 | 9.96 |
| hFMCL2b-LCNT/hFMCH4c | 8.41 | 8.47 | 7.54 | 16.54 | 10.24 |
| hFMCL2b-LCNT/ hFMCH4b(Q1E) | 7.15 | 10.54 | 6.97 | 20.72 | 11.34 |
| muFMC63 LCNT (Batch 2) | 11.75 | 14.65 | 6.36 | 17.28 | 12.51 |
| hFMCL2b-LCNT/ hFMCH4c(Q1E-V20L) | 7.52 | 15.28 | 14.42 | 14.83 | 13.01 |
| hFMCL2-LCNT/hFMCH4b | 21.44 | 7.43 | 18.73 | 14.64 | 15.56 |
| hFMCL2-LCNT/hFMCH4c | 16.62 | 15.97 | 9.20 | 30.08 | 17.97 |
| hFMCL2-LCNT/hFMCII4a | 43.20 | 50.73 | 28.27 | 40.68 | 40.72 |
| hFMCL2b-LCNT/hFMCH4c-x-(Q1E) | 28.34 | 81.83 | 15.14 | 51.48 | 44.20 |
| hFMCL2b-LCNT/hFMCH4b-x-(Q1E) | 29.60 | 77.64 | 43.84 | 63.94 | 53.76 |
| hFMCL2-LCNT/hFMCH2 | 141.20 | 79.00 | 38.64 | 78.51 | 84.34 |
| hFMCL2-LCNT/hFMCH3 | 139.10 | 77.09 | 61.41 | 72.62 | 87.56 |
| Cells | PBMC | CD4:CD8 | PBMC | CD4:CD8 | |

In contrast to the strong dose-dependent induction of CD19-positive RS4;11 cell cytotoxicity observed by treatment with the sCAR/humanized switch combination (FIG. 10), little to no LDH cytotoxicity of sCAR-EC cells (e.g., sCAR-T cells) against CD19-negative K562 cells was observed by treatment with the sCAR/humanized switch combination (FIG. 11). Thus, cytotoxicity induced sCAR/humanized switch combinations are specific to cells expressing the target antigen (CD19), and non-specific activation of cytotoxicity does not occur merely due to the binding of the switch to its sCAR-T cell.

To determine if a correlation existed between binding affinity (by flow cytometry) and activity (by in vitro cytotoxicity), the affinities were plotted along with the cytokine release and EC$_{50}$ of cytotoxicity for each candidate (waterfall plot of cytotoxicity shown in FIG. 22A, correlations shown in FIG. 22B). A linear relationship was found between affinity and EC$_{50}$ as well as between cytokine release and EC$_{50}$ in vitro with r$^2$'s shown in the figure: Higher potency (lower) EC$_{50}$'s provided higher cytokine release (measured at 0.1 nM of switch) and higher potency (lower) EC$_{50}$'s were found to correlate with higher affinity humanized candidates.

To assay how these candidates functioned in vivo, a NALM-6 assay was conducted using our standard conditions (FIG. 22C). In the first experiment, four candidates, L2b/H4b, L2b/H4c, L2c/H4b, L2c/H4c, were tested in this model using the original 4-1BB-based murine 52SR4 CAR-T candidate (TSY-2-193). In the second experiment, the original 4-1BB-based murine 52SR4 CAR-T candidate was repeated and compared with the third generation 28BB L5H4 candidate sCAR-T cell. Overall the humanized switch candidate L2b/H4c eliminated tumors in 5 of 9 mice. This was superior to other candidates. The alignment of this candidate with the humanized framework regions and the original murine FMC63 sequence is provided in FIG. 23.

The humanized switch candidate L2b/H4c had favorable biophysical characteristics through a developability analysis that included high resolution MS, thermal stability, in silico T cell epitope analysis (immunogenicity), and CIC, SIC, HIC, SEC chromatographies. Specifically, L2b/H4c had improved thermal stability and yields over the chimeric FMC63-based switch (FIG. 22D). Analytical size exclusion showed the L2b/H4c candidate was a monomer.

Example 5

Immunogenicity Analysis of Clone hFMC2b-LCNT/hFMCH4c

Using the EpiMatrix system (EpiVax, Inc, Providence, RI), the amino acid sequence of the light chain huFMCL2b-LCNT (note, in some embodiments, "hu" an "h" are used interchangeably in various constructs, e.g., huFMCL2b and hFMCL2b to designate that the construct is at least partially humanized), and the heavy chain hFMCH4c sequences were analyzed for both overall and regional immunogenic potentials. In addition, we have screened these sequences against the non-redundant human protein databases at GenBank™ for MHC Class II epitopes and the immune epitope database at the La Jolla Institute for Allergy and Immunology, available at the world wide web address: iedb.org/(the contents of which is incorporated herein by reference in its entirety). Finally, we have combined heavy and light chain variable domains in order to evaluate the immunogenic potential of the complete huFMC antibody.

All other factors being equal, the more HLA ligands (i.e. EpiMatrix hits) contained in a given protein, the more likely that protein is to induce an immune response. To capture this concept, we used an EpiMatrix Protein Score. The EpiMatrix Protein Score is the difference between the number of predicted T cell epitopes we would expect to find in a protein of a given size and the number of putative epitopes predicted by the EpiMatrix System. The EpiMatrix Protein Score is correlated with observed immunogenicity. EpiMatrix Protein Scores are "normalized" and can be plotted on a standardized scale. The EpiMatrix Protein Score of an "average" protein is zero. EpiMatrix Protein Scores above zero indicate the presence of excess MHC ligands and denote a higher potential for immunogenicity while scores below zero indicate the presence of fewer potential MHC ligands than expected and a lower potential for immunogenicity. Proteins scoring above +20 are considered to have a significant immunogenic potential.

Adjusting for the Presence of Regulatory T cell Epitopes. Antibodies are unique proteins in that the amino acid sequences of their variable domains, especially their Complementarity Determining Regions (CDRs), can vary to an extraordinary extent. It is this variability that allows antibodies to recognize a wide variety of antigens. However, this flexibility comes with a price. The recombination and mutation events that control antibody maturation can also produce new or neo-T cell epitopes. These neo-epitopes can appear to be "foreign" to circulating T cells. The presence of neo-epitopes in antibody sequences can lead to the formation of a human-anti-human antibody response; the so-called HAHA response.

Regulatory T cells play an important role in suppressing immune responses to fully human proteins in the periphery, including those containing mutated and/or highly variable sequences such as antibody CDRs. Regulatory T cells are engaged and activated by regulatory T cell epitopes. We believe the inherent risk associated with the presence of neo-epitopes in antibody sequences is balanced by the presence of naturally occurring regulatory T cell epitopes.

By screening the sequences of many human antibody isolates, we have identified several highly conserved HLA ligands which we believe have a regulatory potential. Experimental evidence suggests many of these peptides are, in fact, actively tolerogenic in most subjects. We refer to these highly conserved fragments as Tregitopes. The Tregitope observation has been published in Blood (De Groot, A S, et al., Blood (2008) October 15;112 (8): 3303-11; incorporated herein by reference in its entirety), and many candidate Tregitopes are patent pending. In many cases, the immunogenic potential of neo-epitopes contained in humanized antibodies can be effectively controlled in the presence of significant numbers of Tregitopes. For the purposes of antibody immunogenicity analysis, we have developed a Tregitope-adjusted EpiMatrix Score and corresponding prediction of anti-therapeutic antibody response. To calculate the Tregitope-adjusted EpiMatrix Score, we deduct the scores of the Tregitopes from the EpiMatrix Protein Score of the antibody's combined variable domains. In our experience, Tregitope adjusted scores are well correlated with observed clinical immune response.

Figure 12:
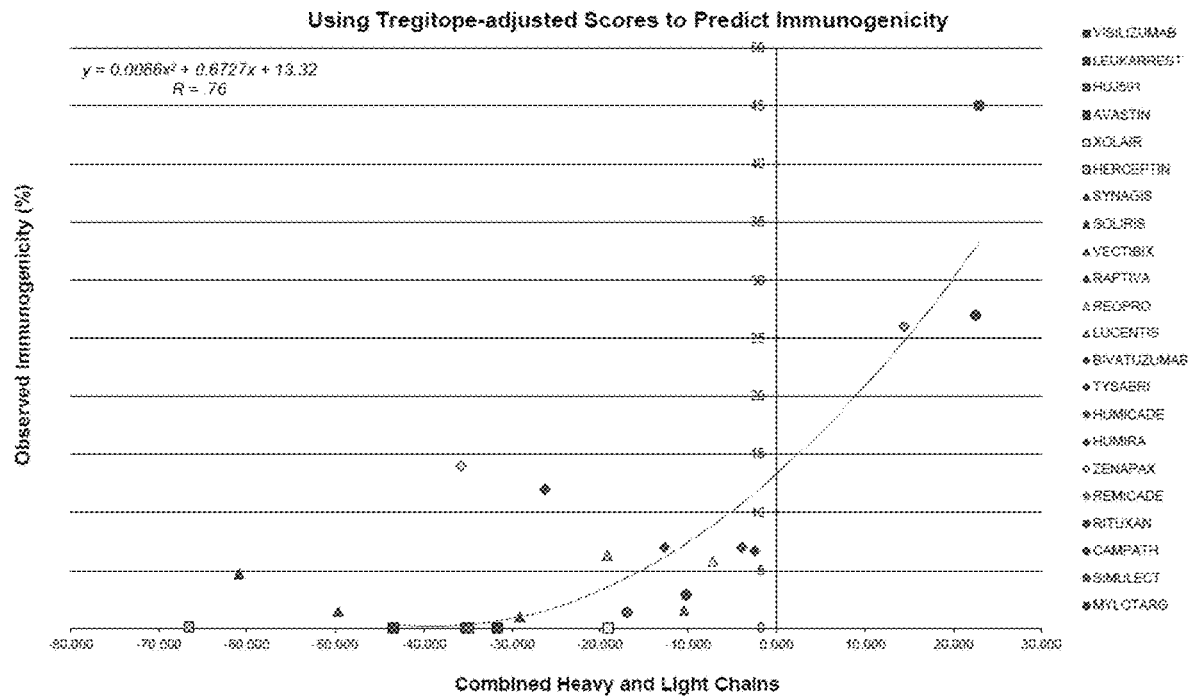
FIG. 12: shows polynomial regression used to predict immunogenicity of an antibody by in silico analysis. Twenty-two licensed antibodies that make up the polynomial regression used for predicting T-cell dependent HAHA responses.

After adjusting for the presence of Tregitopes, the EpiMatrix Protein Scores of antibody variable domains tend to run low. The average Tregitope-adjusted EpiMatrix Protein Score of 22 licensed antibodies is-20.71. Of course, not all antibodies are created equal. Some contain many Tregitopes while others contain few or none at all. The average Tregitope-adjusted EpiMatrix Protein Score of 10 antibodies known to induce anti-therapeutic antibodies in more than 5% of exposed subjects is-4.77. The average Tregitope-adjusted EpiMatrix Protein Score of 12 antibodies known to induce anti-therapeutic antibodies in less than 5% of exposed subjects is-34.01. The presence of significant numbers of Tregitopes correlates well with low observed immunogenicity. Considering all of the antibodies in our sample, the coefficient of correlation between Tregitope-adjusted EpiMatrix Score and observed immunogenicity is 0.76 (see FIG. 12).

It is interesting to note the apparent contradiction between the relatively low Tregitope-adjusted average score of immunogenic antibodies (−4.77) and the relatively high incidence of observed anti-therapeutic immune response. We suggest that neo-epitopes contained in the CDRs of antibodies are significant risk factors even in otherwise low scoring antibodies. As suggested above, we believe the high risk associated with antibody CDRs is probably the evolutionary driver behind the development and retention of Tregitopes within the human antibody germline.

Results.

In analyzing the submitted heavy and light chain sequences a total of 3,520 frame-by-allele assessments were performed. A summary of the findings is presented below in Table 9.

TABLE 9

Overall immunogenic potential of hFMC2b-LCNT/hFMCH4c sequences

| Protein Label | Length | Assessments | EpiMatrix Hits | EpiMatrix Score | Treg-Adj EpiMatrix Score |
|---|---|---|---|---|---|
| huFMC HC | 223 | 1,720 | 104 | 6.63 | −22.51 |
| huFMC LC1 | 233 | 1,800 | 111 | 13.98 | −15.70 |

Table 9 labels: huFMC HC=hFMCH4c; huFMC LC1=hFMC2b-LCNT.

Figure 13:
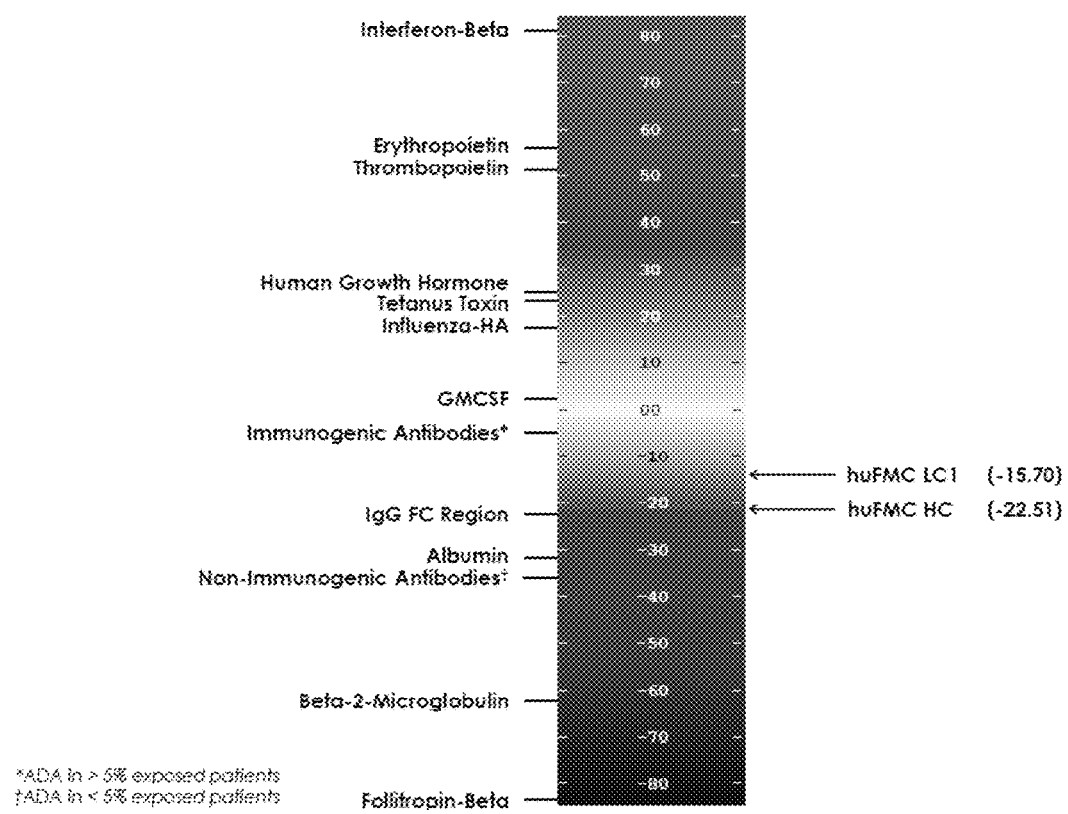
FIG. 13: shows EpiMatrix Protein Immunogenicity Scale with Overall Immunogenic Potential hFMC2b-LCNT (labeled as LC1)/hFMCH4c (labeled as HC) sequences.

FIG. 13 presents our findings on a graphical scale and also shows how the submitted sequences rate against a series of standard controls.

hFMCH4c contains a total of 104 EpiMatrix hits. Its Tregitope-adjusted EpiMatrix Protein Score is-22.51. This score falls on the lower end of our scale and indicates a limited potential for immunogenicity. hFMC2b-LCNT contains a total of 111 EpiMatrix hits. Its Tregitope-adjusted EpiMatrix Protein Score is-15.70. This score falls in the neutral range of our scale and indicates a slightly reduced potential for immunogenicity. Looking at the combined huFMC variable domains, we calculate a Tregitope-adjusted EpiMatrix Protein Score of −13.73, and based on a regression of Tregitope-adjusted EpiMatrix Protein Score against observed clinical immunogenicity in a set of licensed monoclonal antibody products, predict an anti-drug antibody rate of 5.7%. Compared to other licensed antibodies known to be non-immunogenic, these scores are slightly elevated, indicating at least some potential for anti-therapeutic response.

Example 6

Modifying the GCN4 Peptide Epitope

To determine the optimal epitope for binding to the 52SR4 (anti-GCN4) CAR, we modified the GCN4 peptide sequence (SEQ ID NO: 138) at various positions, thus creating GCN4 peptide derivatives.

In SEQ ID NO: 139, the GCN4 epitope was expanded by 3 residues on the N-terminus and 1 residue on the C-terminus.

In SEQ ID NO: 140, residue L1 was mutated to D and N5 was mutated to Q. This was based on an alternative sequence of the GCN4 peptide found in the literature in which the first five residues of the GCN4 peptide are DLPKQ (SEQ ID NO:455) (Zahnd C, et al. *The Journal of Biological Chemistry*, Vol. 279, No. 18, Issue of April 30, pp. 18870-18877, 2004).

In SEQ ID NO: 141, residues K and L were removed from the C-terminus to determine whether a shorter sequence, truncated from the C-terminus was still active In SEQ ID NO: 142, L1 was removed to determine if this residue was involved in activity.

In SEQ ID NO: 143, L1 and L2 were removed to determine if these residues were involved in activity and to understand the viability of expression for a sequence starting with proline.

In SEQ ID NO: 144, L1, L2 and P3 were removed to further truncate the protein to determine impact on activity.

In SEQ ID NO: 145, L1, L2, P3 and K4 were removed to further truncate the protein to determine impact on activity.

In SEQ ID NO: 146, L1, L2, P3, K4 and L18 were removed; K17 was replaced with A to extend the peptide from the C-terminus (separating the GGGGS (SEQ ID NO:93) linker from the peptide) while eliminating the double lysine (KK) motif that existed there in the original peptide sequence.

In SEQ ID NO: 147, K17 was replaced with A to eliminate the double lysine (KK) motif that existed there in the original peptide sequence.

In SEQ ID NO: 148, L1, L2 and P3 were removed; K17 was replaced with A to eliminate the double lysine (KK) motif that existed there in the original peptide sequence and to test this in combination with the extended peptide motif shown in A.

In SEQ ID NO: 149, L1, L2, P3 and K4 were removed; K17 was replaced with A to eliminate the double lysine (KK) motif that existed there in the original peptide sequence.

In SEQ ID NO: 150, L1, L2, P3 and K4 were removed; K17 was replaced with G to eliminate the double lysine (KK) motif that existed there in the original peptide sequence.

In SEQ ID NO: 151, L1, L2, P3 and K4 were removed; K17 was replaced with A and L18 was replaced with A to eliminate the double lysine (KK) motif that existed there in the original peptide sequence.

In SEQ ID NO: 152, L1, L2, and P3 were removed; K17 was replaced with G to eliminate the double lysine (KK) motif that existed there in the original peptide sequence.

In SEQ ID NO: 153, L1, L2, and P3 were removed; K17 was replaced with A and L18 was replaced with A to eliminate the double lysine (KK) motif that existed there in the original peptide sequence.

In SEQ ID NO: 245, L1, L2, P3 and K4 are removed and the epitope is expanded by 1 residue on the C-terminus.

Switches containing each of the peptides listed in Table 10 were created by expression said peptides in the LCNT format on the murine FMC63 anti-CD19 antibody clone in FAB format.

Figure 20:
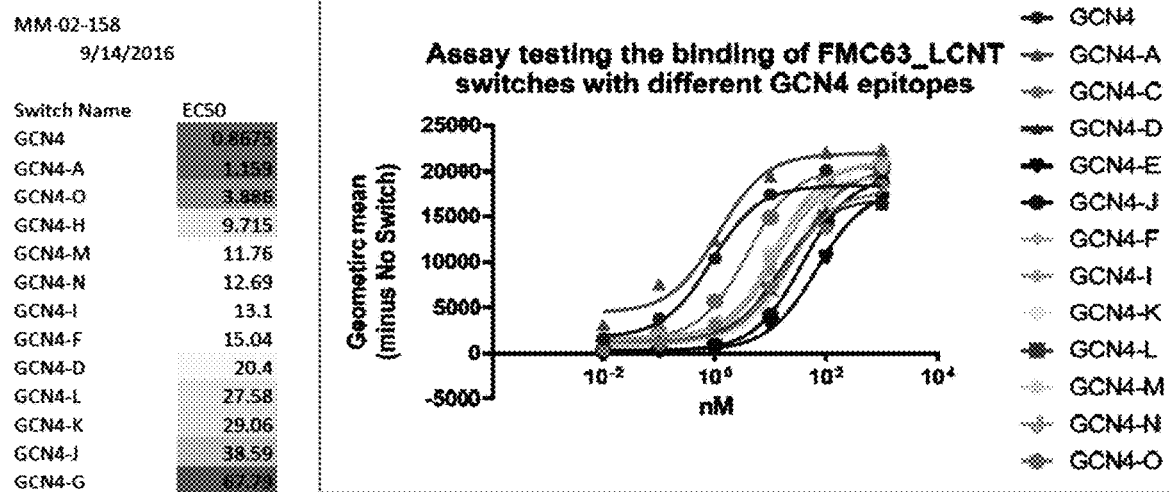
FIG. 20 shows the binding of CAR-EC switches comprising GCN4 peptide derivative CAR-IDs to switchable CAR-T cells (52SR4 and humanized variants sCAR).

The binding of the modified epitope switches to switchable CAR-T cells (52SR4 sCAR) was tested using the same binding assay (detailed above in Example 3) (FIG. 20).

Figure 21:
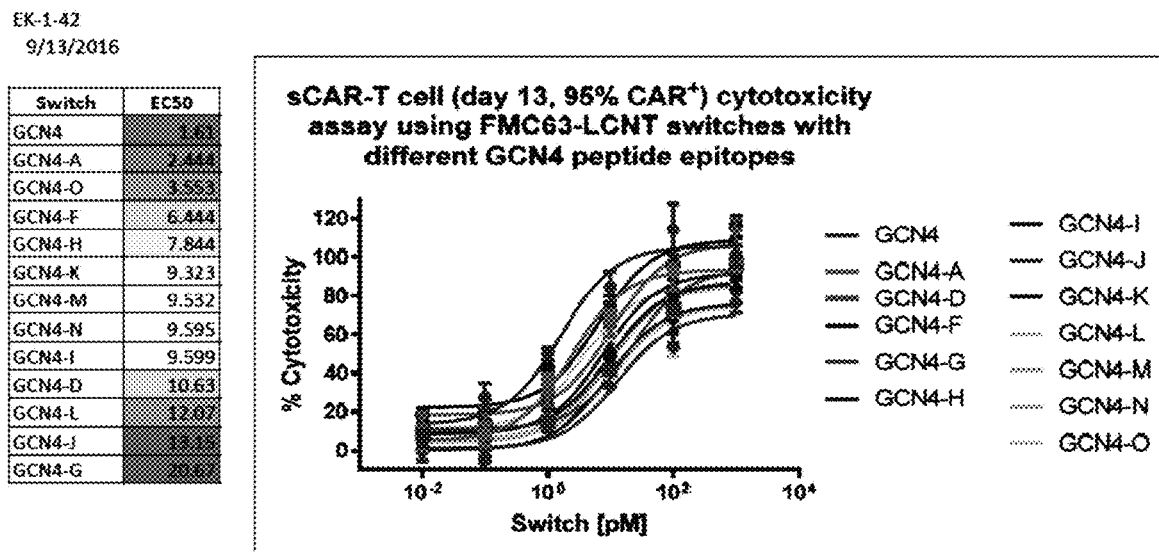
FIG. 21 shows LDH cytotoxicity assays using FMC63-based CAR-EC switches comprising GCN4 peptide derivative CAR-IDs with switchable CAR-T cells (52SR4 sCAR) against CD19+ RS4;11 cells.

The activity of the modified epitope switches was tested in an LDH cytotoxicity assay as described above in Example 4, and the $EC_{50}$ values were determined as described above (FIG. 21).

TABLE 10

| GCN4 epitope sequences | | |
|---|---|---|
| SEQ ID NO | NAME | SEQUENCE |
| 138 | GCN4 | NYHLENEVARLKKL |
| 139 | GCN4-A | LLPKNYHLENEVARLKKL |
| 140 | GCN4-B | DLPKQYHLENEVARLKKL |
| 141 | GCN4-C | LLPKNYHLENEVARLK |
| 142 | GCN4-D | LPKNYHLENEVARLK |
| 143 | GCN4-E | PKNYHLENEVARLK |
| 144 | GCN4-F | KNYHLENEVARLK |
| 145 | GCN4-G | NYHLENEVARLK |
| 146 | GCN4-H | NYHLENEVARLKA |
| 147 | GCN4-I | LLPKNYHLENEVARLKAL |
| 148 | GCN4-J | KNYHLENEVARLKAL |
| 149 | GCN4-K | NYHLENEVARLKAL |
| 150 | GCN4-L | NYHLENEVARLKGL |
| 151 | GCN4-M | NYHLENEVARLKAA |
| 152 | GCN4-N | KNYHLENEVARLKGL |
| 153 | GCN4-O | KNYHLENEVARLKAA |
| 245 | GCN4-GK | NYHLENEVARLKK |

Example 7

Comparison of Costimulatory Domains

To determine the effect of the costimulatory domain on sCAR-T cell activity, the anti-GCN4 peptide sCAR scFv (clone 52SR4) was subcloned from our previously reported second generation 4-1BB based construct [Rodgers, D. T. (2016)] to vectors harboring a second generation CD28 costimulatory (costim) domain or a third generation CD28/4-1BB (28BB) costim domain [Zhang (2007); Zhong (2010)]. The IgG4m hinge (SEQ ID NO: 168) and CD8 transmembrane (TM) (IYIWAPLAGTCGVLLLSLVIT-LYC; SEQ ID NO: 398) domains were retained as to be consistent with our previous designs. Transduction of these constructions into healthy donor-derived T cells failed to demonstrate surface expression of the scFv (data not shown). As second generation and third generations constructs have been widely used elsewhere, we hypothesized the failure of our constructs was due to an incompatibility in the fusion of the CD8TM or IgG4m hinge region with the CD28 costim. To test this hypothesis, the CD28 TM or CD28 TM with CD28 hinge were used to replace the CD8 TM and IgG4m hinge to produce sCAR constructs A-F (FIG. 24A). Transduction into healthy donor-derived cells demonstrated both IgG4m hinge/CD28TM/CD28 costim and CD28 hinge/CD28TM/CD28 costim expressed scFv to the surface of the cell, confirming the incompatibility of the CD8 TM with CD28 costim in the early constructs. The sequences of the various extracellular, transmembrane, and intracellular domains included in the CAR constructs are shown in FIG. 24C.

Figure 25A:
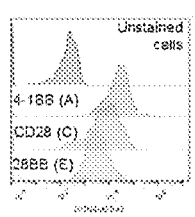
FIGS. 25A-25G show comparison of different costimulatory domains.
Figure 25B:
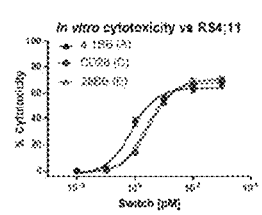
Figure 25C:
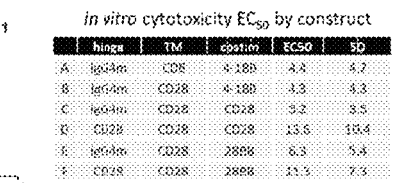
Figure 25D:
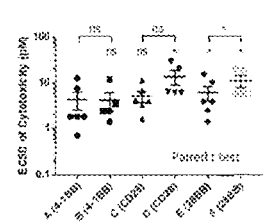

Flow binding experiments using Alexa Fluor™ 647-labeled GCN4 peptide (binds tightly to and labels the anti-GCN4 scFv) demonstrated the 28BB construct (E) afforded lower surface expression compared with constructs harboring CD28 (C) or 4-1BB (A) costimulatory domains alone (FIG. 25A). In vitro cytotoxicity assays demonstrated the 28BB constructs (E) also had marginally weaker $EC_{50}$ of cytotoxicity using titration of an anti-CD19 switch against $CD19^+$ RS4;11 cells compared with the original construct (A) (FIG. 25B to FIG. 25D). No activity against antigen negative cells was observed with either hinge nor transmembrane changes, indicating the specificity of the sCAR-T cell was not corrupted (data not shown). In line with our previous hypothesis that a shorter immunological synapse results in more potent cytotoxicity, constructs with the short 12 amino acid IgG4m hinge (A, B, and C) had more potent cytotoxicity in these assays than the corresponding longer 39 amino acid CD28 hinge constructs (D) and F) (FIGS. 25C and 25D). This effect was consistent across multiple donors. In contrast, no difference in the $EC_{50}$ of cytotoxicity was found between the CD8 (A) and CD28 (B) based transmembrane domains.

Figure 25E:
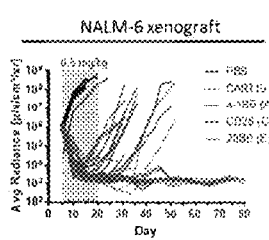
Figure 26:
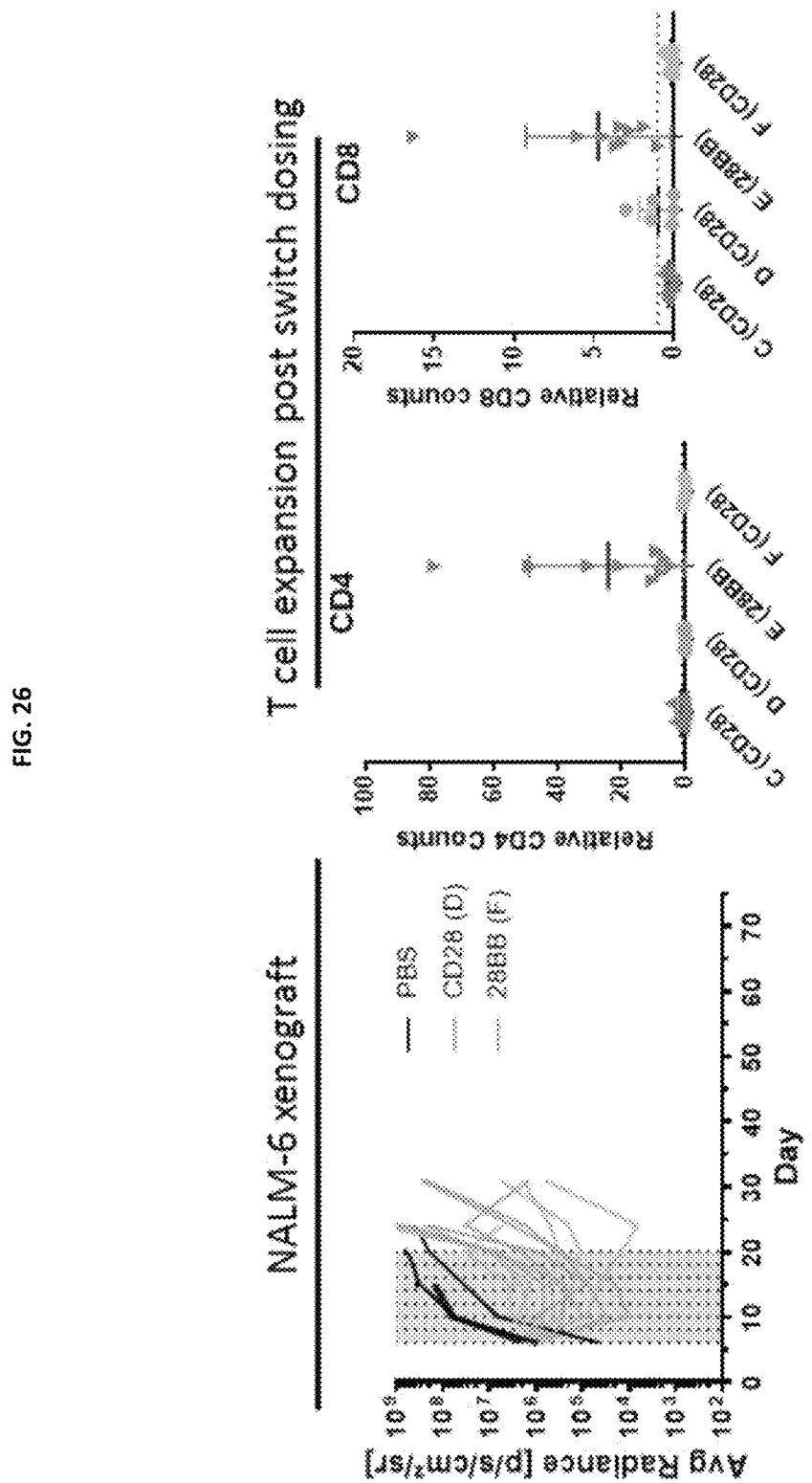
FIG. 26 shows in vivo efficacy of the CD28-hinge based sCAR-T cells from the NALM-6 model shown in FIG. 25D.

Constructs were next tested in an in vivo NALM-6 xenograft model in which a single dose of sCAR-T cells (iv) was provided to NSG mice with established tumor burden, followed by every other day dosing of the switch (iv) for 14 days and monitoring of mice for relapse. This model employed half the number of CAR-T cells than our previous report [Rodgers (2016)] to create a more challenging model in order to emphasize the differences between constructs. To increase robustness of the comparison, the model was run with T cells from three separate donors. Under these conditions, the original 4-1BB based construct (A) afforded variable elimination of disease. In this model, the 28BB construct (E) cleared tumor (7 of 9 mice cleared post-dosing) more effectively than 4-1BB (A) (3 of 7 mice cleared post-dosing) (FIG. 25E). The CD28-based construct (C) demonstrated relapse during the dosing period and failed to clear any mice (0 of 8 mice cleared). In line with our previous results, the IgG4m hinge was requisite for in vivo activity, as constructs (D) and (F), which employed the CD28 hinge with CD28 and or BB28 costim domains, respectively, failed to significantly control tumor burden in any animals (FIG. 26).

Figure 25F:
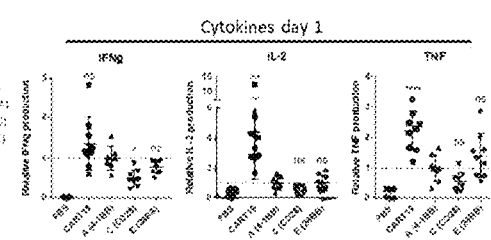
Figure 25G:
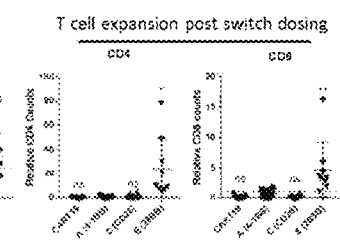

The acute cytokine release, measured 24 h after the first dose of switch, was similar between 4-1BB (A), CD28 (C) and 28BB (E) constructs, with only the CD28 construct (C) exhibiting lower levels of IFNg than the original 4-1BB construct (A) (FIG. 25F). This was compared with the conventional CAR-T construct modeled after the recently approved Kymriah (CART19) which employs the 4-1BB costimulatory domain and CD8TM and hinge. CART19 exhibited significantly greater IL-2 and TNF cytokine release under these conditions. Remarkably, the BB28 construct with the IgG4m hinge (E) exhibited a 24-fold increase in CD4 and a 5-fold increase in CD8 cell expansion directly following the dosing period compared with the original 4-1BB-based construct (A) (FIG. 25G). This expansion was approximately 41-fold and 15-fold greater than CD4 and CD8 in CART19, respectively. The greater expansion of CD4 cells over CD8 compared with the 4-1BB costimulatory domain is in line with previous reports that the addition of the CD28 stimulation can increase CD4 expansion [Kagoya (2017)]. Therefore, the third generation 28BB based construct (E) can produce significantly greater T cell expansion resulting in greater efficacy in the switchable CAR-T platform but with markedly lower cytokine release.

Example 8

Humanization of the sCAR

The 52SR4 scFv that directs the specificity of the sCAR for the PNE peptide of the switch was derived from directed evolution of a murine antibody library [Hanes (1998); Zahnd (2004)]. These murine sequences have the potential to be immunogenic in humans. Immunogenicity of the transgene in engineered T cells has caused anaphylaxis in patients and has been shown to be a contributing factor to rejection of the cells from the patient [Berger (2006); Jensen (2010); Maus (2013)]. For these reasons we humanized the 52SR4 scFv.

Briefly, murine 52SR4 sequences for variable heavy (VH) and variable light (VL) domains were submitted to the IgBLAST program on the NCBI website (www.ncbi.nlm.nih.gov/igblast/). Each murine sequence was compared to murine germline sequences and then compared to human germline sequences. The murine VH sequence is derived from murine IGHV2-6-7 germline and the murine VL sequence is derived from murine IGLV1 germline (FIG. 27A). The murine VH is closest to human VH germline IGHV4-59 and murine VI is closest to human VI kappa germline IGLV7-46.

The murine VH sequence was aligned with human IGHJ4-59VH; CDR definition is provided in FIG. 27A (world wide web address: bioinf.org.uk/abs/). Four different humanized VH frameworks were used to generate humanized sequences: h52SR4H1-H4 (FIG. 28). h52SR4H1 (constructs referred to as H1, 2, 3, 4 . . . etc. throughout) is a CDR-swap in which the murine CDRs have been transplanted onto human IGHJ4-59 framework (i.e., with no framework changes). h52SR4H2 added framework changes at positions 71 (sequential numbering), which affects CDR-H2 conformation, and positions 93-94, which can affect CDR-H3 conformation. h52SR4H3 added additional buried framework changes to improve internal packing of the VH domain. h52SR42b/3b tested addition of Asn73. Based on Zahnd et al. [Zahnd (2004)], LeuH28Ser (H30 in Zahnd et al. AHo antibody numbering) and IleH56Ser/Thr (H67 in Zahnd et al. AHo antibody numbering) improved binding affinity. At both positions the hydrophobic sidechain is completely exposed to solvent. LeuH30 would not have a direct interaction with the target in crystal structure PDB IP4B, while IleH56 has only a minor interaction with target.

Murine VL was aligned with human IGLV-7-46; CDR definition is provided in FIG. 27A (www.bioinf.org.uk/abs/). Several different humanized VL frameworks were used to generate humanized sequences: h52SR4VL1-3 (constructs referred to as L1, 2, 3 . . . etc. throughout) (FIG. 29). CDR-L1 and CDR-L2 include sequences that have a low propensity for deamidation. Computer graphics models of the VH: VL pairs of murine and humanized 5F11 were constructed to aid in the humanization. From this alignment and analysis, unique humanized scFv sequences were constructed and cloned in place of the murine 52SR4 scFv in the original second generation 4-1BB-based construct (A in FIG. 24A; SEQ ID NO: 389).

Based on our initial results comparing the costimulatory domains, neither levels of CAR expression nor in vitro efficacy could sufficiently predict the superior in vivo efficacy of the 28BB construct. Further, conventional CD19 and GD2 CARs that have equivalent in vitro efficacy, have been shown to have very different in vivo antitumor activities due to differences in tonic signaling [Gargett (2016)]. For this reason, to identify humanized candidates for further investigation we ran an in vivo screen in the NALM-6 xenograft mouse model.

Forty-five humanized candidates (Table 11) in the 4-1BB vectors (see Construct A, FIG. 24A) were transduced individually into healthy human donor-derived T cells and injected (iv) into separate NSG mice (minimum N=3 for each candidate).

TABLE 11

Humanized CAR variants used in FIG. 27B

| | Unique Clone name | LC and HC |
|---|---|---|
| 1. | TSY-3-192 | L5H4 |
| 2. | TSY-3-190 | L5H6 |
| 3. | TSY-3-191 | L2H6 |
| 4. | TSY-3-193 | L6H6 |
| 5. | TSY-4-19 | L5H4-E6Q |
| 6. | TSY-4-20 | L5H6-73T |
| 7. | TSY-4-23 | L5-12S, H4-E6Q |
| 8. | TSY-4-24 | L6-46F, H4-E6Q |
| 9. | TSY-4-83 | L5-109D, H4 |
| 10. | TSY-4-84 | L5del109, H4 |
| 11. | TSY-4-85 | L5H4-A87D |
| 12. | ENH-4-129 | L5(12S)H4 |
| 13 | ENH-4-130 | L5(12S-69D) H4 |
| 14. | ENH-4-132 | L5(12S-23R) H4 |
| 15. | ENH-4-133 | L5(12S) H487S) |
| 16. | ENH-4-134 | L5(12S) H487D) |
| 17. | ENH-4-135 | L5(12S-69D-109S) (H487S) |
| 18. | ENH-4-136 | H4L5(12S) |
| 19. | ENH-4-137 | H4(87S) L512S-69D-109S) |
| 20. | ENH-4-138 | LC H4 |
| 21. | ENH-4-140 | LC H4(87S) |
| 22. | ENH-4-141 | L5(12S-69D-109S) |
| 23. | ENH-4-85 | L5 H4-A87D |
| 24. | ENH-5-40 | L5-L109D H4-A87D, E6Q |
| 25. | ENH-5-41 | L5-V12S, L109D H4-A87D |
| 26. | ENH-5-42 | L5-V12S, L109D H4-A87D, E6Q |
| 27. | ENH-5-43 | L5-109D, HC |
| 28. | ENH-5-44 | L5-12S, 109D, HC |
| 29. | ENH-5-45 | LC, H4-A87D, E6Q |
| 30. | ENH-5-46 | LC, H4-A87D |
| 31. | ENH-5-59 | H4(E6Q), L5 |
| 32. | ENH-5-47 | L2 H4-A87D |
| 33. | ENH-5-48 | L3 H4-A87D |
| 34. | ENH-5-49 | L4 H4-A87D |
| 35. | ENH-5-50 | L5(V12S) H4-A87D |
| 36. | ENH-5-51 | L5-V12S H4-A87D |
| 37. | ENH-5-52 | L5-dL109 H4-A87D |
| 38. | ENH-5-53 | L5-V12S, L69D H4-A87D |
| 39. | ENH-5-54 | L5- V12S, G23R H4-A87D |
| 40. | ENH-5-55 | L5-V12S, L69D, L109S H4-A87D |
| 41. | ENH-5-56 | L6 H4-A87D |
| 42. | ENH-5-57 | L6-P46F H4-A87D |
| 43. | ENH-4-86 | L5-L109D H4-A87D |
| 44. | ENH-5-141 | L5 H4-E6Q, A87D |
| 45. | TSY-4-70 | L2 H3 |

Treatment with switch was carried out every other day for 14 days per our standard protocol (FIG. 27B). Clones that afforded complete tumor elimination (<10° radiance by IVIS, approximately the limit of detection of tumor in this model, at day 50, 30 days after the last dosage of switch) were selected for further study (Table 12).

TABLE 12

Humanized CAR variants used in FIG. 27B

| | Unique Clone name | LC and HC |
|---|---|---|
| 1. | TSY-4-19 | L5H4-E6Q |
| 2. | TSY-4-83 | L5-109D, H4 |
| 3. | TSY-4-84 | L5del109, H4 |

TABLE 12-continued

Humanized CAR variants used in FIG. 27B

| | Unique Clone name | LC and HC |
|---|---|---|
| 4. | TSY-4-85 | L5H4-A87D |
| 5. | ENH-5-40 | L5-L109D H4-A87D, E6Q |
| 6. | ENH-5-42 | L5-V12S, L109D H4-A87D, E6Q |

Figure 30:
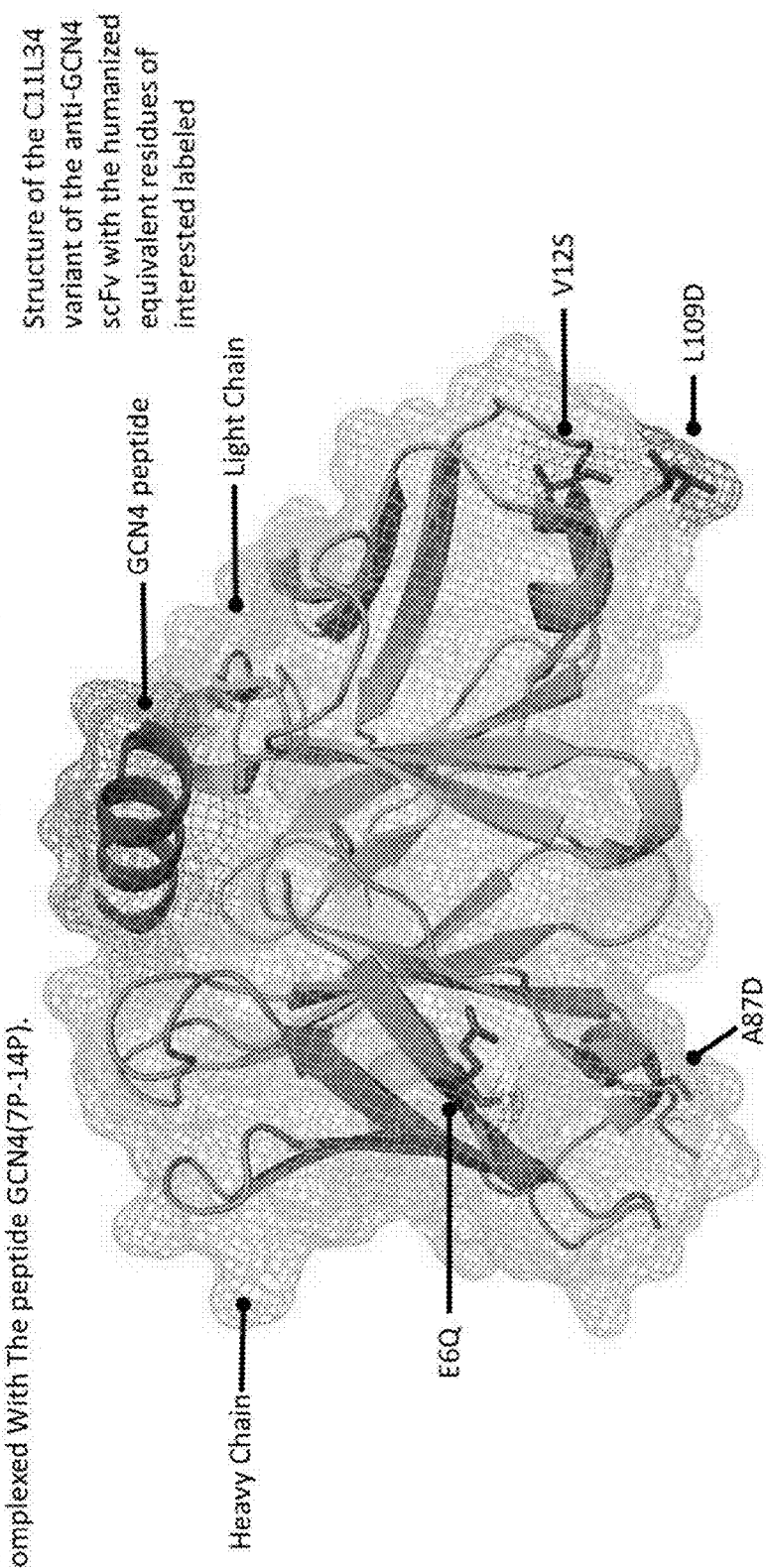
FIG. 30 shows a model of the crystal structure of an anti-GCN4 scFv variant (C11L34; Green: Heavy chain; Light blue: Light chain) complexed with GCN4 peptide (Dark Blue). Humanized residues are labeled in red.

These clones were derived from the base clone light chain sequence L5 and heavy chain sequence H4 with mutations in the light chain at V12S or L109D, and heavy chain at E6Q or A87D (FIG. 30).

Although these mutations do not directly interact with the peptide binding, they have been reported or hypothesized to have other effects, including long-range conformational changes, or impacts on protein folding that may affect the scFv structure and correlatively the sCAR-T cell activity. Furthermore, with the exception of the buried HC E6Q residue, the residues were surface exposed, suggesting they may also play a role in protein-protein interactions through non-specific hydrophobic interactions. This may be significant in the case of scFvs which have certain residues of the former Fab variable region/constant region interface exposed, resulting in a higher frequency of hydrophobicity in scFv molecules compared with Fabs [Nieba (1997)].

The LC V12S mutant was identified in the Zahnd et al. (2004) (referred to as LC T13S in the publication using AHo numbering scheme) as a mutation which arose from in vitro evolution of the 52SR4 scFv from the parent C11L34 base clone. It is possible that this mutation increases the affinity of the scFv; however, based on the existing data we cannot exclude that it is a passenger in the evolution of high affinity in the 52SR4 clone. The LC 109 residue is the penultimate amino acid of the light chain with the final amino acid being glycine, followed by a GGGGS (SEQ ID NO:93) linker. Although this residue was not identified through the previous in vitro evolution studies and is conserved across the human and mouse frameworks, it protrudes from the structure, forming a hydrophobic surface that may increase interactions with other non-specific proteins. Thus, the LC L109D mutation may be beneficial in reducing surface hydrophobicity.

According to Zahnd et al. (2004), the HC "mutation H6 (Glu to Gln) improved the affinity, by a factor of 2, to 20 pM when compared with clone C11L34", supporting the study of this mutation in the HC. It was hypothesized in the publication that this mutation exerted an effect though "long range interactions or 'molecular shimming,' influencing the orientation or flexibility of a loop or domain." In other reference this residue has been shown to influence the conformation of the N-terminal portion of the heavy chain [Honegger (2001)]. Therefore, there was good support for further investigation of the impact of this residue on sCAR-T cell activity. Finally, the surface exposed HC residue 87 has been previously studied in development of the Apr. 4, 2020 anti-FITC scFv [Nieba (1997)]. In this study, the Nieba, et al. found that mutation of this residue to D (84D in Kabat numbering) reduced aggregation in protein folding, while not significantly altering the binding affinity or thermal stability of the scFv. Thus, good support existed for studying these mutations.

To test the effect of these mutations on sCAR-T cell function, 7 humanized scFv variants were created from the L5H4 base clone along with the mutations discussed above (FIG. 27C). To test their activity amongst different costimulatory domains, the CARs were subcloned into 4-1BB, CD28, or 28BB-based vectors (A, C, or E, respectively, in FIG. 24A) to create 21 total vectors. The rationale to test in multiple costimulatory domain backgrounds was to pressure test the sCARs with the context that CD28-based costimulatory domains have been shown to exacerbate tonic signaling while 4-1BB may mask tonic signaling [Long (2015)]. Therefore, testing sCAR-T cell activity in the context of a single costimulatory domain may not be sufficient to differentiate activity. In vitro cytotoxicity assays demonstrated that the variants had insignificant differences in $EC_{50}$ of cytotoxicity against CD19 RS4; 11 cells with titration of the anti-CD19 switch (FIG. 27D).

The candidates were next compared with the murine 52SR4 sCAR construct for their ability to eliminate NALM-6 tumors in vivo (FIG. 27E). During the expansion of cells for these models, CAR+ T cells were sorted by affinity column to normalize potential differences in CAR expression that resulted from the scFv variant. Correspondingly, tumor elimination in these models was found to be slightly improved compared with previous models shown in FIGS. 25A-25G. CAR vectors with 4-1BB or CD28-based costimulatory domains had variable tumor elimination, however sorting had improved the ability of CD28-based CARs to control tumor burden compared with our initial models. Due to the potency of the third generation 28BB costimulatory domain, all candidates and the murine CAR completely eliminated tumor after the dosing period. To pressure test this model further, mice were rechallenged at day 30 with NALM-6 again. No additional CAR-T cells were provided, and switch dosing was initiated 6 days after challenge (day 36) per the standard protocol. At day 36, tumor burden in these animals was comparable to the initial challenge suggesting the sCAR-T cells had no effect on tumor growth in the absence of the switch dosing. The second dosing period was carried out as with the first, every other day for 14 days, after which tumor was again eliminated in all groups. The majority of mice remained clear through the end of the study with relapse in a small number of individual mice apparent at day 60.

Figure 31:
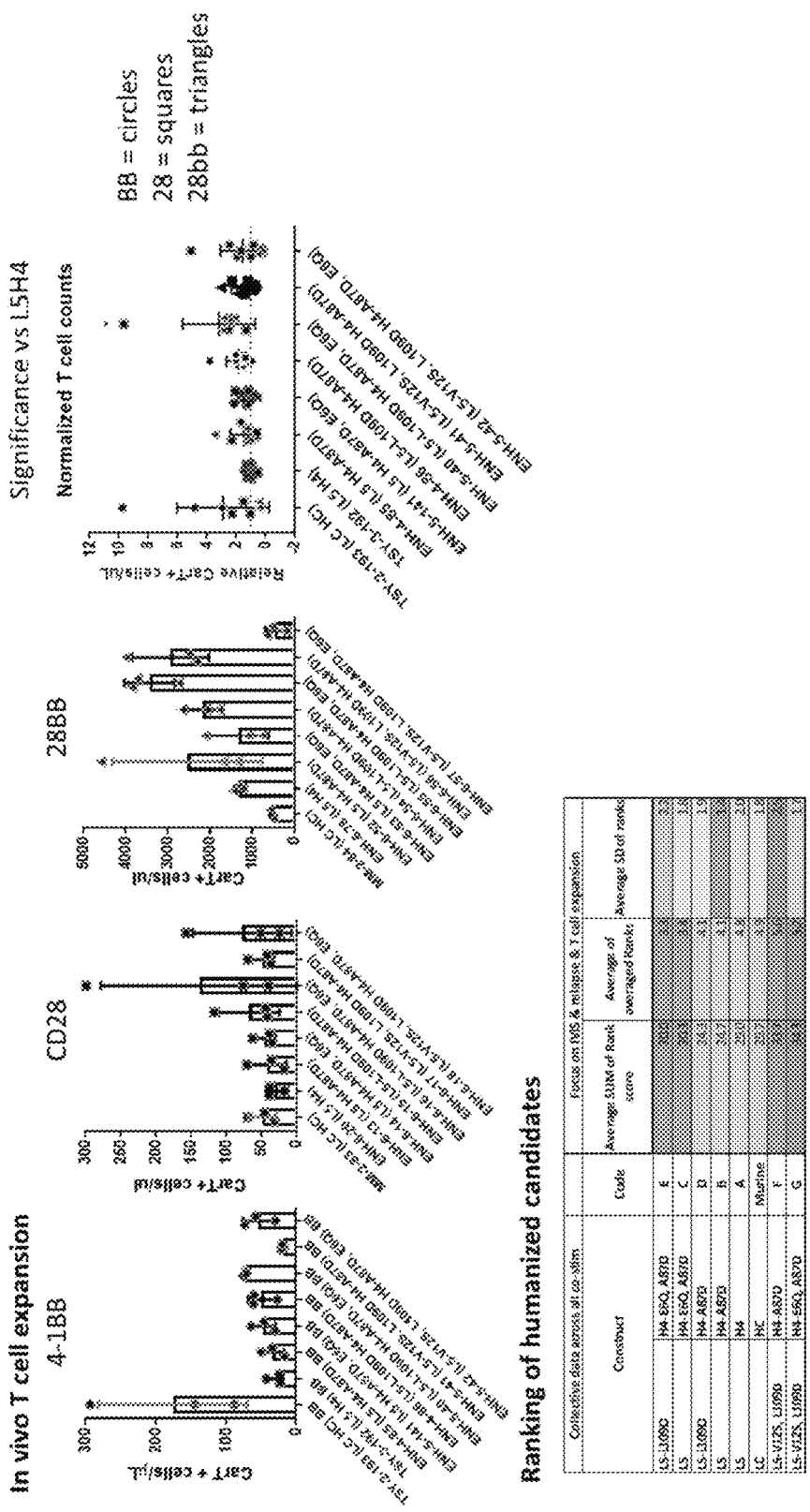
FIG. 31 shows experimental results of humanized murine switchable CARs. Upper three left graphs show comparisons of CAR-T cell expansion across 41BB, CD28 and 3rd Generation 28BB co-stimulatory domains of murine and humanized CAR variants from in vivo efficacy xenograft models. On day 21, after Nalm6 injection, blood was collected and stained for CAR-T and analyzed by flow cytometry. Upper right graph shows normalized CAR-T cell counts of anti-tumor efficacy in vivo assays. Values were normalized to the L5H4 construct. Significance is by one-way Anova. Lower panel shows ranked humanized CAR constructs. Cytokines, frequency and time of relapses, and T cell expansion values from in vivo models were ranked for each construct and averaged accordingly.
Figure 32:
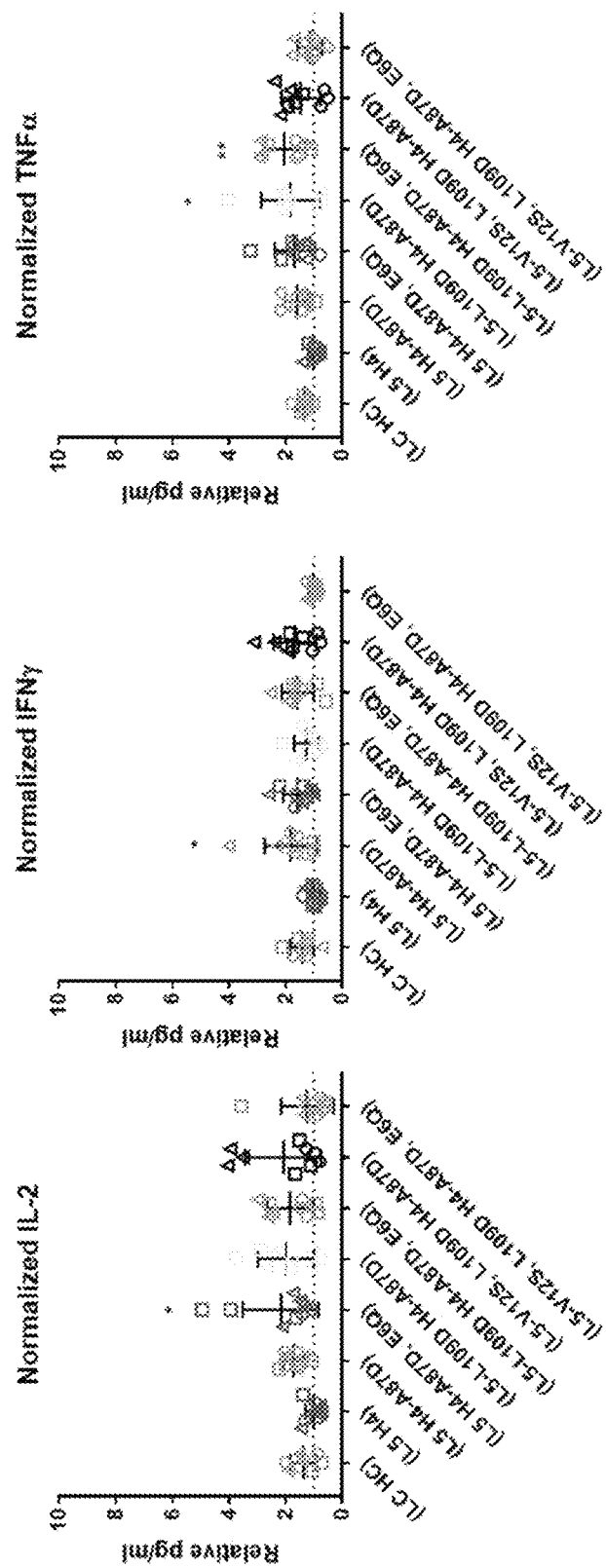
FIG. 32 shows in vivo cytokine production comparison. Mouse serum from efficacy xenograft models was collected 24 h after CAR-T and switch injection and cytokines quantified. Graphs show normalized values to L5H4 CAR-T group. Significance by one-way Anova.

All sCARs in these experiments exhibited promising levels of tumor clearance. To differentiate the most promising candidates the in vivo function of the humanized scFv was averaged across multiple co-stimulatory domain formats (CD28+CD3z, 4-1BB+CD3z and CD28+41BB+CD3z) to remove bias introduced by the respective signaling features of each construct. The terms "CD3z"; "CD3 zeta"; and "CD3ζ" are used interchangeably, herein. The following in vivo parameters were averaged across each CAR-T construct: (A) tumor IVIS value at day 10, 20, 31 and 45 post tumor challenge; (B) T cell expansion measured 2 days after the end of switch dosing, and (C) day of tumor relapse (IVIS ROI>104). Each parameter series was ranked for disease relevance: (A) representing tumor clearance/relapse, was ranked low to high; (B) representative of T cell expansion throughout activation, was ranked high to low; and (C) representative of level of initial tumor clearance, was ranked low to high. Therefore, through this analysis the best CAR constructs would have low tumor burden (A) with strong T cell expansion (B) and relapse infrequently (C). Each parameter was ranked within each co-stimulatory domain cohorts and then averaged to produce a total rank score. The standard deviation of the ranks was calculated as a measure of rank variance. Using this ranking system, the sCAR E (L5-L109D, H4-E6Q, A87D) was the most promising candidate (FIG. 31). The addition of the LC L109D, HC E6Q, and HC A87D to the L5H4 base clone significantly increased T cell expansion in vivo. Cytokines were marginally different among the sCAR candidates (FIG. 32). As found previously with the comparison of costimulatory domains, the cytokine release at 24 h was not predictive of in vivo efficacy and thus was not included in the ranking of sCAR candidates. However, it should be noted that the 28BB CARs release greater TNFalpha than their 4-1BB counterparts, albeit, not significantly in FIGS. 25A-25G. Similarly, the sCAR E candidate released greater TNFa than other clones, correlating with its in vivo activity.

Figure 33:
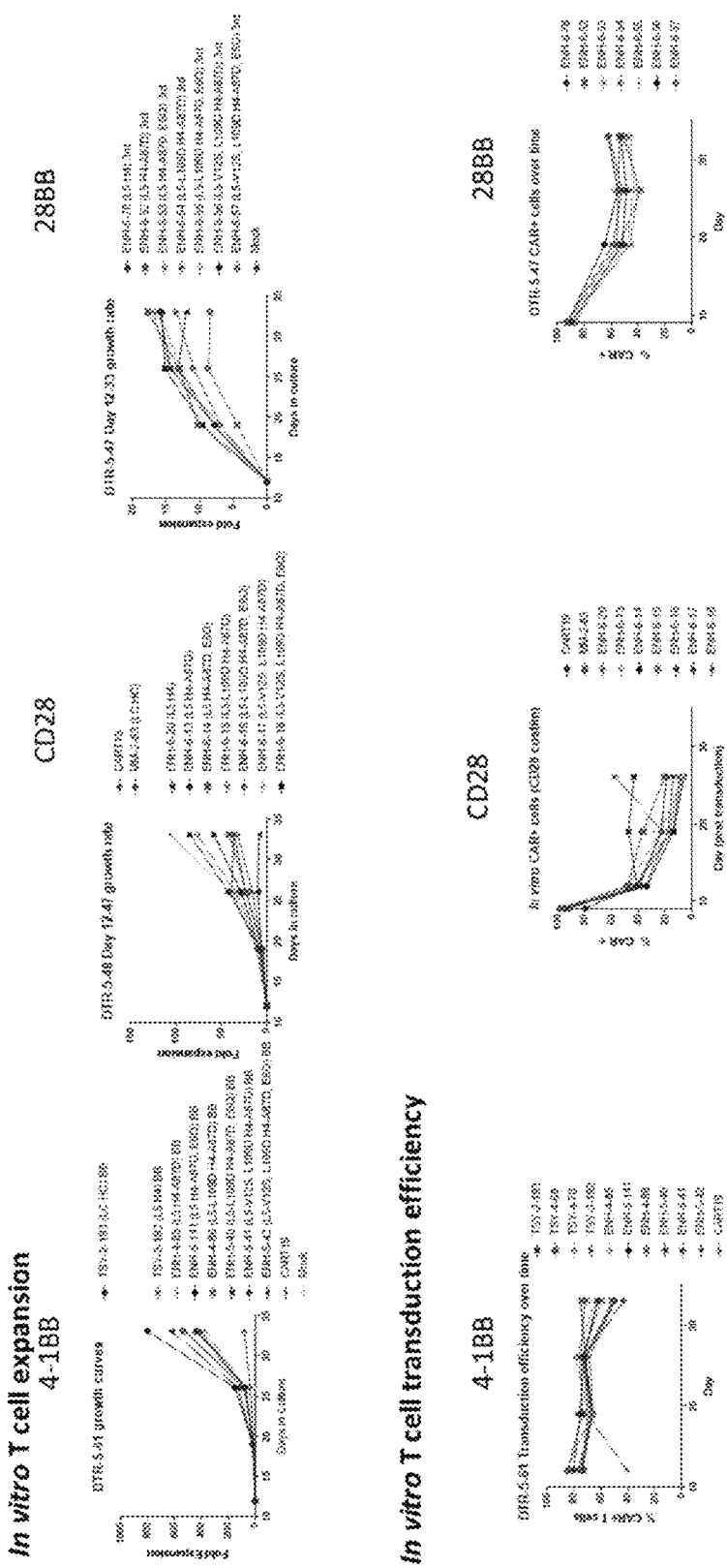
FIG. 33 shows in vitro characterization of humanized CAR constructs. Upper panels: T cell expansion comparison across 41BB, CD28, and 3rd Gen 28BB humanized constructs. Lower panels: Transduction efficiency of 41BB, CD28, and 3rd Gen 28BB humanized CAR constructs over time.

We further investigated these candidates using extended ex vivo expansion (FIG. 33). Briefly, the assays were conducted by transducing healthy donor-derived T cells individually with each CAR candidate. Cultures were activated at day zero with CD3/CD28 beads and IL-2 was provided throughout the culture process, but the cells were not re-stimulated. Candidates were sorted for CAR+ cells at day 5 and expanded in culture flasks for 33 days with analysis of number of cells, transduction efficiency (CAR+ cells), and in vitro cytotoxicity weekly. As has been reported elsewhere, CAR candidates with 4-1BB based costimulatory domains expanded nearly 103-fold after sorting, while CD28 and third generation CARs had markedly lower expansion (FIG. 33) Transduction efficiency for 4-1BB-based CARs remained consistent while CD28-based CARs had a marked loss in CAR+ cells. It was not determined if this was due to loss of CAR expression or due to the expansion of CAR-negative cells overtaking the CAR+ cells in cell culture. Third generation 28BB-based CARs lost some transduction efficiency after sorting but appeared to normalize near 50%.

Figure 34:
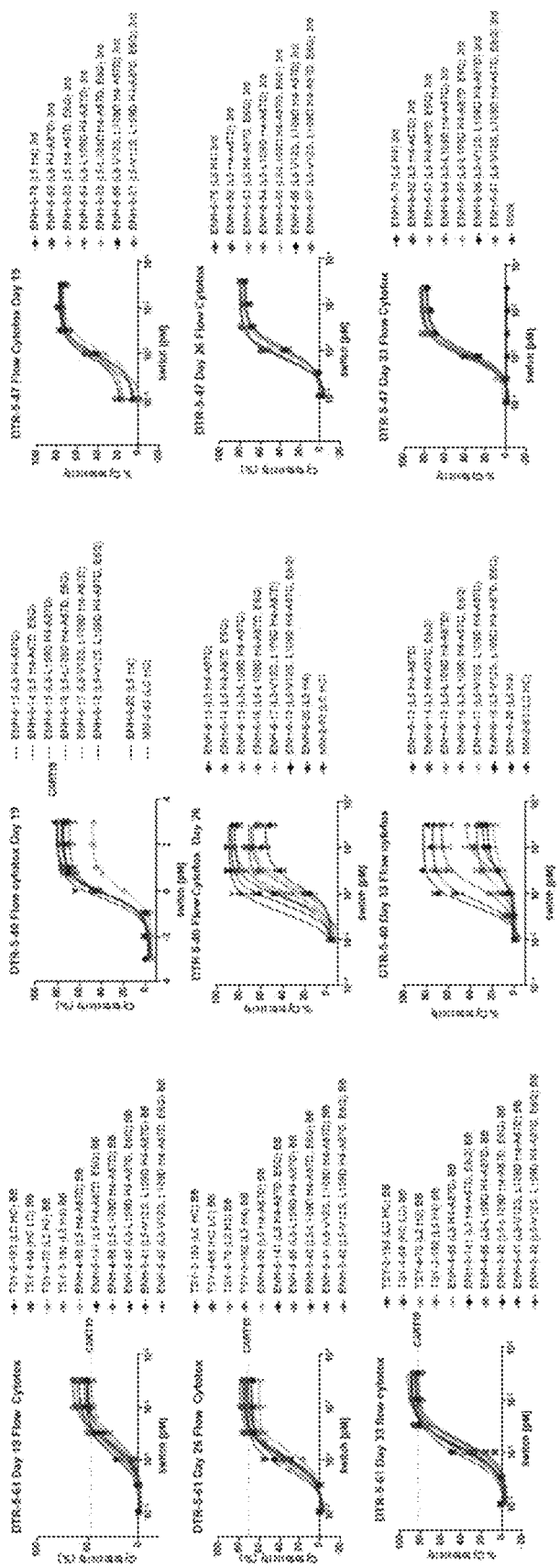
FIG. 34 shows in vitro cytotoxicity of humanized CAR constructs over time. Left, middle, and right columns represent 41BB, CD28, and $3^{rd}$ Gen 28BB CAR constructs respectively. Rows show dose-response cytotoxicity 19, 26, and 33 days after T cell transduction from top to bottom, respectively.
Figure 35:
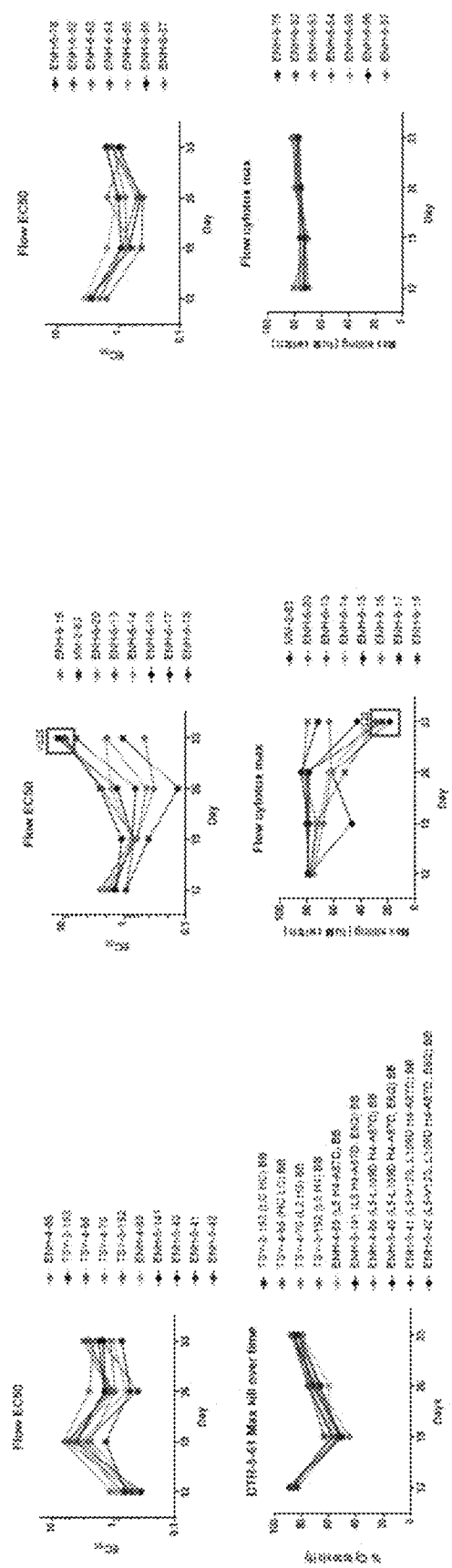
FIG. 35 shows in vitro cytotoxicity of humanized CAR constructs over time. Top row shows $EC_{50}$ values from cytotoxicity assays over time after T-cell transduction. Bottom row shows maximum killing of each construct over time after T-cell transduction.

In vitro cytotoxicity was tested weekly for each candidate (FIG. 34 and FIG. 35). Throughout the course of the extended ex vivo expansion assay, 4-1BB-based candidates had similar $EC_{50}$ of cytotoxicity and maximum levels of cytotoxicity (defined by the % lysed target cells using a saturating amount of switch molecule). Similarly, BB-28 candidates had similar $EC_{50}$s and maximum target cell lysis throughout the time course. Interestingly, CD28-based candidates lost potency, exhibited by an increase in $EC_{50}$ of cytotoxicity along with a decrease in maximum target cell lysis. This was most apparent for clones harboring the V12S mutation. Correspondingly these clones score weakest on their ability to control tumor burden in vivo.

Example 8

Combination of Humanized Switch and Humanized Car

Figure 36:
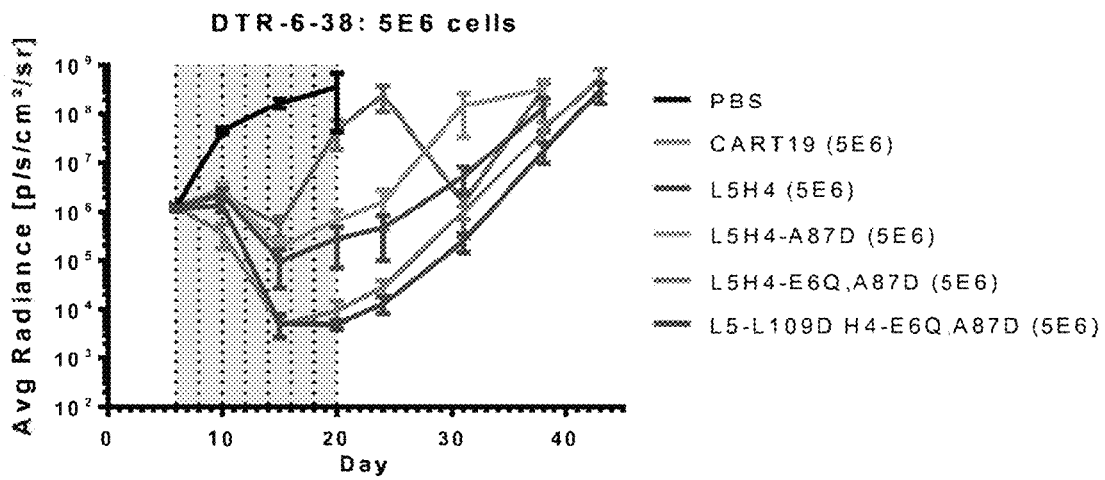
FIG. 36 shows a NALM-6 xenograft model using a combination of the humanized switch and humanized CAR. Tumor burden was established by injecting NSG mice iv with $0.5 \times 10^6$ NALM-6 cells. Six days later, $5 \times 10^6$ sCAR-T or CART19 cells were injected, followed by 8 doses of humanized L2b/H4c switch administered every other day over the period of 14 days (0.5 mg/kg). N=6.

To determine the efficacy of the humanized switch candidate L2b/H4c with the humanized sCAR candidates L5H4 (FIGS. 27C-27E, candidate A), L5H4-A87D (FIGS. 27C-27E, candidate B), L5H4-E6Q,A87D (FIGS. 27C-27E, candidate C), and L5-L109D-H4-E6Q,A87D (FIGS. 27C-27E, candidate E), a NALM-6 model was conducted as previously described, except 5 million sCAR-T cells were used instead of 20 million cells (FIG. 36). Under these conditions, CAR-T cell efficacy is challenged, resulting in a reduction, but not elimination of tumor. These conditions thus allow resolution of minor differences between the humanized sCAR candidates. In this model candidate E provided the greatest control of tumor burden. The activity of this sCAR when paired with the L2b/H4c humanized switch was comparable to the conventional CART-19.

Example 9

Heterogeneous Tumors

Figure 37A:
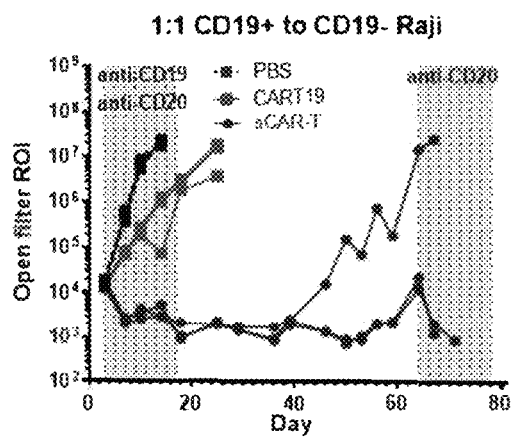
FIGS. 37A-37C show a heterogeneous Raji CD19+/CD19− xenograft model. Tumor burden was established by injecting NSG mice with a mixture of Raji CD19+ and Raji CD19− cells ($0.5 \times 10^6$ total cells per mouse). 3 days later, $10 \times 10^6$ sCAR-T or CART19 cells were injected, followed by 8 doses of anti-CD19 switch (0.5 mg/kg) over the period of 14 days. Eight doses of anti-CD20 switch (0.5 mg/kg) were administered once the average ROI exceeded $10^5$, indicating relapse of CD19− Raji cells.
Figure 37B:
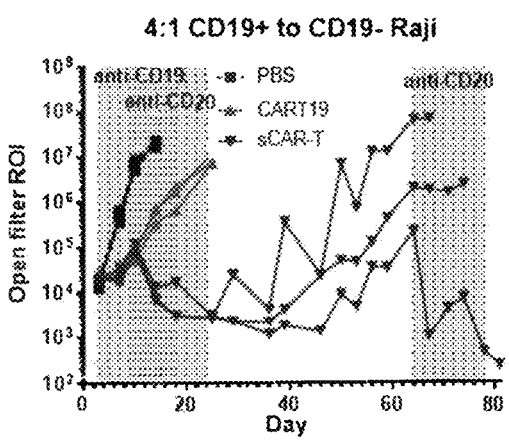
Figure 37C:
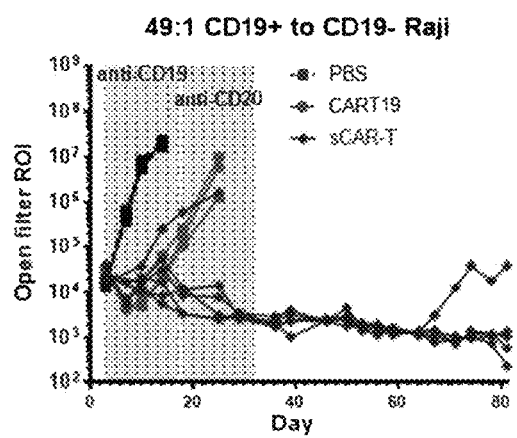

The ability of sCAR-T cells to target more than one tumor antigen at the same or different times was tested in a heterogeneous Raji xenograft tumor model. Raji cells, naturally positive for CD19 and CD20, were modified by CRISPR knockout of the gene for CD19 resulting in a CD19-CD20+Raji cell line. Wild type Raji cells were mixed with this cell line at ratios of 1:1, 4:1, or 49:1, respectively, and injected IV into NSG mice to establish disseminated tumors (FIGS. 37A-37C). Both cell lines were luciferized to follow tumor burden by IVIS. After 3 days, the mice were treated with sCAR-T cells or CART-19. In the 1:1 group, switch dosing with mixed anti-CD19 switch and anti-CD20 switch commenced on day 3, four hours after delivery of the sCAR-T cells (FIG. 37A). In this model, CART-19 modestly slowed tumor burden but was unable to eliminate tumor completely. This was hypothesized to be due to the ability of CART-19 to eliminate the wild type Raji cells without having a detrimental effect on the growth of the CD19-negative Raji cells. The sCAR-T cell group eliminated tumor in 3 of 3 mice using a mixture of anti-CD19 and anti-CD20 switches. Relapse of tumor was observed and treated with anti-CD20 switch. This subsequent switch treatment eliminated tumor in 2 of the 3 mice. This experiment demonstrated the same sCAR-T cell can be redirected to multiple tumor antigens simultaneously.

A second model using a 4:1 mixture (FIG. 37B) of wild type Raji cells to CD19-negative Raji cells was carried out similarly to the 1:1 model, except in this model, dosing stated with the anti-CD19 switch only. When tumor burden (presumed to be from the CD19-negative population) rose to a radiance of 105 (average), mice were treated with the anti-CD20 switch using the standard every other day for 14 days dosing regimen. This was effective at eliminating tumor in all mice. Relapse was treated with additional anti-CD20 switch which eliminated tumor in 1 of 3 mice. The CART-19 group had marginal activity against the mixture of cells, with animals ultimately succumbing to the CD19-negative Raji tumor burden as in model one.

A third model using 49:1 mixture (FIG. 37C) of wild type Raji cells to CD19-negative Raji cells was carried out similarly to the 4:1 model. When tumor burden (presumed to be from the CD19-negative population) rose to a radiance of 105 (average), mice were treated with the anti-CD20 switch using the standard every other day for 14 days dosing regimen. In this group, dosing with anti-CD20 switch started one day after the completion of anti-CD19 dosages. Similar to the first and second models, CART19 cells eliminated wild type Raji cells, but not CD19-negative Raji cells with all tumors relapsing in this group. Conversely, 5 out of 6 mice treated with sCAR T cells and anti-CD19 and anti-CD20 switches presented no tumor after the dosing period, with one relapse close to the end of the model Together, second and third models demonstrated that the same sCAR-T cells can be redirected to different antigens sequentially rather than simultaneously.

Example 10

Syngeneic System

A fully murine, syngeneic switchable CAR-T cell platform was developed to test the activity of sCAR-T cells in the context of an immunocompetent animal model. In these models, C3H immunocompetent mice were used with the 38c13 tumor cell line. Briefly, mice were inoculated with tumor SC at day zero and tumors allowed to establish between 500-1000 $mm^3$. Mice were then preconditioned with cyclophosphamide and murine sCAR-T cell delivered 24 hours later, with switch doses commencing 4 hours after sCAR-T cells and continuing every other day for 14 days. Only a single dose of sCAR-T cells were provided to the animals.

Figure 39A:
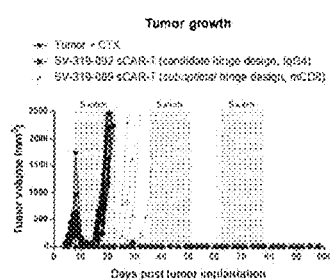
FIGS. 39A-39E show a syngeneic system.

Differential activity based on hinge length was found in our preliminary reports for human sCAR-T cells. To determine if this effect was observed in the mouse system, murine sCARs were constructed harboring the IgG4 short, dimeric hinge (murine sCAR SV-319-092) or with the mouse CD8 hinge (murine sCAR SV-319-089). Constructs are described in FIG. 38). In vivo SV-319-092 afforded complete elimination of tumor, while SV-319-089 had markedly weaker control, supporting our prior conclusions that shorter hinges afford greater efficacy in sCAR-T cells due to a shorter immunological synapse (FIG. 39A). Thus, the murine system is a physiologically similar platform to our human system and well suited for studying sCAR-T cell activity.

Figure 39B:
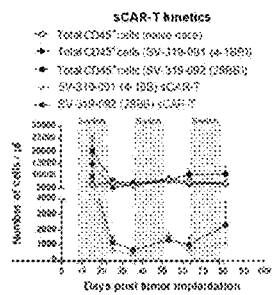

Different hinge constructs were tested next. Briefly, murine sCAR-T cells were constructed with CD28 (SV-319-090), 4-1BB (SV-391-091), or BB28 (SV-319-092) murine costimulatory domains (Group 2 in FIG. 38) and tested in the 38c13 model in C3H mice. The SV-319-090 construct with the murine costimulatory domain failed to control tumor burden with all mice succumbing to disease prior to day 35 (data not shown). Both SV-391-091 and SV-319-092 eliminated tumor in all mice (data not shown). Second and third cycles of dosing in these animals were provided after tumor elimination as in FIG. 39B and sCAR-T cell populations measured periodically. In this experiment, murine sCAR-T cells expanded after each dosing with SV-319-092 28BB-based murine sCAR-T cell expanding marginally better than the SV-391-091 4-1BB-based murine sCAR-T cell. Thus, this experiment demonstrated the expansion potential of the 28BB-based costimulatory domain. Murine CD28-based costimulatory domain sCAR-T cells were excluded from this analysis due to their failure to survive beyond day 35

Figure 39C:
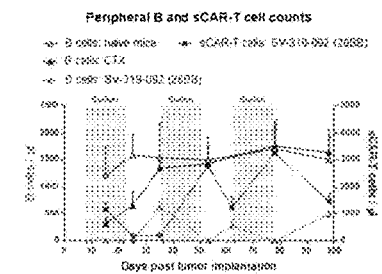

The SV-319-092 28BB-based murine sCAR-T was also able to efficiently eliminate B cells. In a model where both B cells and T cells were measured (FIG. 39C), murine sCAR-T cells expanded after each dose and were inversely related to B cell populations. A rest phase was included between each dosing period. The rest phase allowed B cells to repopulate the mouse as shown in FIG. 39C.

Figure 39D:
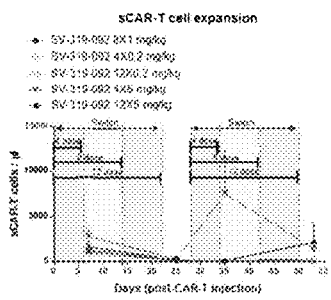
Figure 39E:
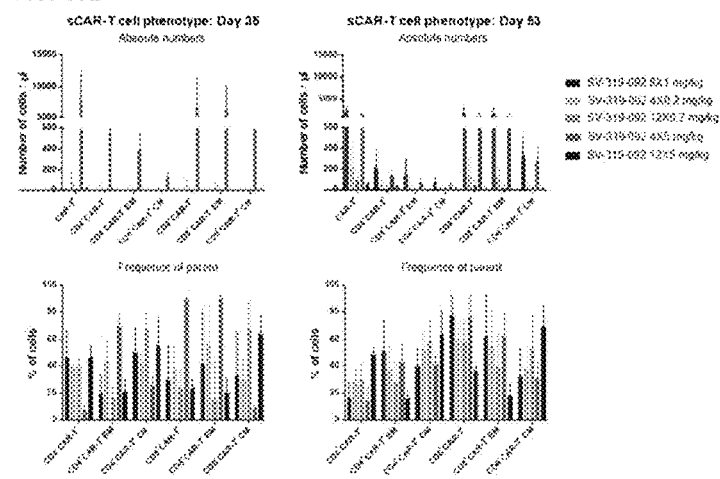

To determine if switch dosing had an impact on memory the murine sCAR-T cell model, SV-319-092 cells were injected into preconditioned mice without tumor. Dosing was then provided in four different regimens (FIG. 39D): high (5 mg/kg) or low (0.2 mg/kg) for short (4 doses) or long (12 doses) dosing periods using every other day IV injection. This was compared with the existing dosing regimen of 8 doses every other day. These dosing periods were followed by a rest phase shown in FIG. 39D. After the rest phase, dosing was resumed with each group receiving the same regimen as prior, still every other day dosing. After 4 doses (6 total days), T cell counts and phenotypes were measured. Remarkably, the high, short group demonstrated a 103 fold expansion compared with the other groups. This expansion was transient and declined after dosing had stopped. This finding demonstrates that the murine sCAR-T cells have memory of their prior dosing regimen and when re-synced after a rest phase, that memory can be recalled, creating large expansions of cells. Phenotyping of the cells in FIG. 39E illustrates the expansion was dominantly effector memory CD8 cells at day 35. After dosing had stopped, at day 53, a contraction of the effector memory population was observed, while a central memory population was comparatively similar to day 35. This finding highlights the utility of temporal control over sCAR-T cell activity, provided by a switch.

REFERENCES

1. Zola H, et al. Preparation and characterization of a chimeric CD19 monoclonal antibody. Immunology and cell biology. 1991; 69 (Pt 6):411-22. Epub 1991/12/01. doi: 10.1038/icb.1991.58. PubMed PMID: 1725979.
2. Porter D L, et al. Chimeric antigen receptor-modified T cells in chronic lymphoid leukemia. The New England journal of medicine. 2011; 365(8):725-33. Epub 2011/08/13. doi: 10.1056/NEJMoa1103849. PubMed PMID: 21830940.
3. Grupp S A, et al. Chimeric antigen receptor-modified T cells for acute lymphoid leukemia. The New England journal of medicine. 2013; 368(16):1509-18. Epub 2013/03/27. doi: 10.1056/NEJMoa1215134. PubMed PMID: 23527958.
4. Porter D L, et al. Chimeric antigen receptor T cells persist and induce sustained remissions in relapsed refractory chronic lymphocytic leukemia. Science translational medicine. 2015; 7(303):303ra139. doi: 10.1126/scitranslmed.aac5415. PubMed PMID: 26333935.
5. Rodgers D T, et al. Switch-mediated activation and retargeting of CAR-T cells for B-cell malignancies. Proceedings of the National Academy of Sciences of the United States of America. 2016; 113(4):E459-68. doi: 10.1073/pnas.1524155113. PubMed PMID: 26759369.
6. Zhang, H., et al., 4-1BB is superior to CD28 costimulation for generating CD8+ cytotoxic lymphocytes for adoptive immunotherapy. J Immunol, 2007. 179(7): p. 4910-8.
7. Zhong, X. S., et al., Chimeric antigen receptors combining 4-1BB and CD28 signaling domains augment PI3kinase/AKT/Bcl-XL activation and CD8+ T cell-mediated tumor eradication. Mol Ther, 2010. 18(2): p. 413-20.
8. Kagoya, Y., et al., Transient stimulation expands superior antitumor T cells for adoptive therapy. JCI Insight, 2017. 2(2): p. e89580.
9. Hanes, J., et al., Ribosome display efficiently selects and evolves high-affinity antibodies in vitro from immune libraries. Proc Natl Acad Sci USA, 1998. 95(24): p. 14130-5.
10. Zahnd, C., et al., Directed in vitro evolution and crystallographic analysis of a peptide-binding single chain antibody fragment (scFv) with low picomolar affinity. J Biol Chem, 2004. 279(18): p. 18870-7.
11. Berger, C., et al., Analysis of transgene-specific immune responses that limit the in vivo persistence of adoptively transferred HSV-TK-modified donor T cells after allogeneic hematopoietic cell transplantation. Blood, 2006. 107 (6): p. 2294-302.
12. Jensen, M. C., et al., Antitransgene rejection responses contribute to attenuated persistence of adoptively transferred CD20/CD19-specific chimeric antigen receptor redirected T cells in humans. Biol Blood Marrow Transplant, 2010. 16(9): p. 1245-56.
13. Maus, M. V., et al., T cells expressing chimeric antigen receptors can cause anaphylaxis in humans. Cancer Immunol Res, 2013. 1(1): p. 26-31.
14. Gargett, T., et al., GD2-specific CAR T Cells Undergo Potent Activation and Deletion Following Antigen Encounter but can be Protected From Activation-induced Cell Death by PD-1 Blockade. Mol Ther, 2016. 24(6): p. 1135-49.
15. Nieba, L., et al., Disrupting the hydrophobic patches at the antibody variable/constant domain interface: improved in vivo folding and physical characterization of an engineered scFv fragment. Protein Eng, 1997. 10(4): p. 435-44.
16. Honegger, A. and A. Pluckthun, Yet another numbering scheme for immunoglobulin variable domains: an automatic modeling and analysis tool. J Mol Biol, 2001. 309(3): p. 657-70.
17. Long, A. H., et al., 4-1BB costimulation ameliorates T cell exhaustion induced by tonic signaling of chimeric antigen receptors. Nat Med, 2015. 21(6): p. 581-90.

The various embodiments described above can be combined to provide further embodiments. All of the U.S. patents, U.S. patent application publications, U.S. patent application, foreign patents, foreign patent application and non-patent publications referred to in this specification and/or listed in the Application Data Sheet are incorporated herein by reference, in their entirety. Aspects of the embodiments can be modified, if necessary to employ concepts of the various patents, application and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (455 sequences)

SEQ ID NO: 1 - protein, 97 aa, Artificial Sequence
  Synthesized heavy chain sequence
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAR

SEQ ID NO: 2 - protein, 120 aa, Artificial Sequence
  Synthesized heavy chain sequence
QVQLQESGPGLVKPSETLSLTCTVSGVSLPDYGVSWIRQPPGKGLEWIGVIWGSETTYYNPSLKSRVTISVDTSKNQFSLKLSSVTAADTAVYYCARHYYYGGSYAMDYWGQGTLVTVSS

SEQ ID NO: 3 - protein, 120 aa, Artificial Sequence
  Synthesized heavy chain sequence
QVQLQESGPGLVKPSETLSVTCTVSGVSLPDYGVSWIRQPPGKGLEWLGVIWGSETTYYNPSLKSRLTISKDTSKNQVSLKMSSLTAADTAVYYCARHYYYGGSYAMDYWGQGTLVTVSS

SEQ ID NO: 4 - protein, 120 aa, Artificial Sequence
  Synthesized heavy chain sequence
QVQLQESGPGLVKPSETLSVTCTVSGVSLPDYGVSWIRQPPGKGLEWLGVIWGSETTYYNPSLKSRLTISKDNSKNQVSLKMSSLTAADTAVYYCARHYYYGGSYAMDYWGQGTLVTVSS

SEQ ID NO: 5 - protein, 120 aa, Artificial Sequence
  Synthesized heavy chain sequence
QVQLQESGPGLVKPSETLSVTCTVSGVSLPDYGVSWIRQPPGKGLEWLGVIWGSETTYYNPSLKSRLTISKDTSKNQVSLKMSSLTAADTAVYYCAKHYYYGGSYAMDYWGQGTLVTVSS

SEQ ID NO: 6 - protein, 120 aa, Artificial Sequence
  Synthesized heavy chain sequence
QVQLQESGPGLVKPSETLSVTCTVSGVSLPDYGVSWIRQPPGKGLEWLGVIWGSETTYYNPSLKSRLTISKDNSKNQVSLKMSSLTAADTAVYYCAKHYYYGGSYAMDYWGQGTLVTVSS

SEQ ID NO: 7 - protein, 120 aa, Artificial Sequence
  Synthesized heavy chain sequence
QVQLQESGPGLVKPSETLSVTCTVSGVSLPDYGVSWIRQPPGKGLEWLGVIWGSETTYYNSALKSRLTISKDNSKNQVSLKMSSLTAADTAVYYCAKHYYYGGSYAMDYWGQGTLVTVSS

SEQ ID NO: 8 - protein, 120 aa, Artificial Sequence
  Synthesized heavy chain sequence
QVQLQESGPGLVKPSETLSVTCTVSGVSLPDYGVSWIRQPPGKGLEWLGVIWGSETTYYNSSLKSRLTISKDNSKNQVSLKMSSLTAADTAVYYCAKHYYYGGSYAMDYWGQGTLVTVSS

SEQ ID NO: 9 - protein, 120 aa, Artificial Sequence
  Synthesized heavy chain sequence
QVQLQESGPGLVKPSETLSLTCTVSGVSLPDYGVSWIRQPPGKGLEWIGVIWGSETTYYNPSLKSRVTISKDNSKNQFSLKLSSVTAADTAVYYCAKHYYYGGSYAMDYWGQGTLVTVSS

SEQ ID NO: 10 - protein, 120 aa, Artificial Sequence
  Synthesized heavy chain sequence
QVQLQESGPGLVKPSETLSLTCTVSGVSLPDYGVSWIRQPPGKGLEWIGVIWGSETTYYNSALKSRVTISKDNSKNQFSLKLSSVTAADTAVYYCAKHYYYGGSYAMDYWGQGTLVTVSS

SEQ ID NO: 11 - protein, 120 aa, Artificial Sequence
  Synthesized heavy chain sequence
EVQLQESGPGLVKPSETLSLTCTVSGVSLPDYGVSWIRQPPGKGLEWLGVIWGSETTYYNSALKSRLTISKDNSKNQVSLKMSSLTAADTAVYYCAKHYYYGGSYAMDYWGQGTLVTVSS

SEQ ID NO: 12 - protein, 120 aa, Artificial Sequence
  Synthesized heavy chain sequence
EVQLQESGPGLVKPSETLSVTCTVSGVSLPDYGVSWIRQPPGKGLEWLGVIWGSETTYYNPSLKSRLTISKDNSKNQVSLKMSSLTAADTAVYYCAKHYYYGGSYAMDYWGQGTLVTVSS

SEQ ID NO: 13 - protein, 120 aa, Artificial Sequence
  Synthesized heavy chain sequence
EVQLQESGPGLVKPSETLSVTCTVSGVSLPDYGVSWIRQPPGKGLEWLGVIWGSETTYYNSALKSRLTISKDNSKNQVSLKMSSLTAADTAVYYCAKHYYYGGSYAMDYWGQGTLVTVSS

SEQ ID NO: 14 - protein, 120 aa, Artificial Sequence
  Synthesized heavy chain sequence
EVQLQESGPGLVKPSETLSLTCTVSGVSLPDYGVSWIRQPPGKGLEWLGVIWGSETTYYNPSLKSRLTISKDNSKNQVSLKMSSLTAADTAVYYCAKHYYYGGSYAMDYWGQGTLVTVSS

SEQ ID NO: 15 - protein, 120 aa, Artificial Sequence
  Synthesized heavy chain sequence
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 16 - protein, 96 aa, Artificial Sequence
  Synthesized light chain sequence
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP

SEQ ID NO: 17 - protein, 107 aa, Artificial Sequence
  Synthesized light chain sequence
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKLEIK

SEQ ID NO: 18 - protein, 107 aa, Artificial Sequence
  Synthesized light chain sequence
DIQMTQSPSSLSASVGDRVTITCRASQDISKYLNWYQQKPGKAPKLLIYHTSRLHSGVPSRFSGSGSGTDYTLTISSLQPEDFATYYCQQGATLPYTFGQGTKLEIK

SEQ ID NO: 19 - protein, 107 aa, Artificial Sequence
  Synthesized light chain sequence
DIQMTQSPSSLSASVGDRVTITCRASQDISKYLNWYQQKPGKAVKLLIYHTSRLHSGVPSRFSGSGSGTDYTLTISSLQPEDFATYYCQQGATLPYTFGQGTKLEIK

SEQ ID NO: 20 - protein, 107 aa, Artificial Sequence
  Synthesized light chain sequence
DIQMTQSPSSLSASVGDRVTITCRASQDISKYLNWYQQKPGKAVKLLIYHTSRLHSGVPSRFSGSGSGTDYTLTISSLQPEDFATYFCQQGATLPYTFGQGTKLEIK

SEQ ID NO: 21 - protein, 107 aa, Artificial Sequence
  Synthesized light chain sequence
DIQMTQSPSSLSASVGDRVTITCRASQDISKYLNWYQQKPGKAPKLLIYHTSRLHSGVPSRFSGSGSGTDYTLTISSLQPEDFATYFCQQGATLPYTFGQGTKLEIK

SEQ ID NO: 22 - protein, 107 aa, Artificial Sequence
  Synthesized light chain sequence
DIQMTQSPSSLSASVGDRVTITCRASQDISKYLNWYQQKPGKALKLLIYHTSRLHSGVPSRFSGSGSGTDYTLTISSLQPEDFATYFCQQGATLPYTFGQGTKLEIK

SEQ ID NO: 23 - protein, 107 aa, Artificial Sequence
  Synthesized light chain sequence
DIQMTQSPSSLSASVGDRVTITCRASQDISKYLNWYQQKPGKAVKLLIYHTSRLHSGVPSRFSGSGSGTDYTLTISSLQPEDFATYFCQQGNTLPYTFGQGTKLEIK

SEQ ID NO: 24 - protein, 107 aa, Artificial Sequence
  Synthesized light chain sequence
DIQMTQSPSSLSASVGDRVTITCRASQDISKYLNWYQQKPGKAIKLLIYHTSRLHSGVPSRFSGSGSGTDYTLTISSLQPEDFATYFCQQGATLPYTFGQGTKLEIK

SEQ ID NO: 25 - protein, 107 aa, Artificial Sequence
  Synthesized light chain sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIK

SEQ ID NO: 26 - protein, 14 aa, Saccharomyces cerevisiae
NYHLENEVARLKKL

SEQ ID NO: 27 - protein, 126 aa, Artificial Sequence
  Synthesized light chain sequence
NYHLENEVARLKKLGGGGSDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKLEIK

SEQ ID NO: 28 - protein, 126 aa, Artificial Sequence
  Synthesized light chain sequence
NYHLENEVARLKKLGGGGSDIQMTQSPSSLSASVGDRVTITCRASQDISKYLNWYQQKPGKAPKLLIYHTSRLHSGVPSRFSGSGSGTDYTLTISSLQPEDFATYYCQQGATLPYTFGQGTKLEIK

SEQ ID NO: 29 - protein, 126 aa, Artificial Sequence
  Synthesized light chain sequence
NYHLENEVARLKKLGGGGSDIQMTQSPSSLSASVGDRVTITCRASQDISKYLNWYQQKPGKAVKLLIYHTSRLHSGVPSRFSGSGSGTDYTLTISSLQPEDFATYYCQQGATLPYTFGQGTKLEIK

SEQ ID NO: 30 - protein, 126 aa, Artificial Sequence
  Synthesized light chain sequence
NYHLENEVARLKKLGGGGSDIQMTQSPSSLSASVGDRVTITCRASQDISKYLNWYQQKPGKAVKLLIYHTSRLHSGVPSRFSGSGSGTDYTLTISSLQPEDFATYFCQQGATLPYTFGQGTKLEIK

SEQ ID NO: 31 - protein, 126 aa, Artificial Sequence
  Synthesized light chain sequence
NYHLENEVARLKKLGGGGSDIQMTQSPSSLSASVGDRVTITCRASQDISKYLNWYQQKPGKAPKLLIYHTSRLHSGVPSRFSGSGSGTDYTLTISSLQPEDFATYFCQQGATLPYTFGQGTKLEIK

SEQ ID NO: 32 - protein, 126 aa, Artificial Sequence
  Synthesized light chain sequence
NYHLENEVARLKKLGGGGSDIQMTQSPSSLSASVGDRVTITCRASQDISKYLNWYQQKPGKALKLLIYHTSRLHSGVPSRFSGSGSGTDYTLTISSLQPEDFATYFCQQGATLPYTFGQGTKLEIK

SEQ ID NO: 33 - protein, 126 aa, Artificial Sequence
  Synthesized light chain sequence
NYHLENEVARLKKLGGGGSDIQMTQSPSSLSASVGDRVTITCRASQDISKYLNWYQQKPGKAVKLLIYHTSRLHSGVPSRFSGSGSGTDYTLTISSLQPEDFATYFCQQGNTLPYTFGQGTKLEIK

SEQ ID NO: 34 - protein, 126 aa, Artificial Sequence; identical to SEQ ID NO: 30
  Synthesized light chain sequence

SEQ ID NO: 35 - protein, 126 aa, Artificial Sequence
  Synthesized light chain sequence
NYHLENEVARLKKLGGGGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIK

SEQ ID NO: 36 - protein, 33 aa, Saccharomyces cerevisiae
RMKQLEPKVEELLPKNYHLENEVARLKKLVGER

SEQ ID NO: 37 - protein, 24 aa, Artificial Sequence
  Synthetic construct - yeast transcription factor GCN4 truncated binding peptide with linkers
GGGGSNYHLENEVARLKKLGGGGS

SEQ ID NO: 38 - protein, 13 aa, Artificial Sequence
  synthetic construct
GGGGSDYKDDDDK

SEQ ID NO: 39 - protein, 14 aa, Artificial Sequence
  synthetic construct
GGGGSDYKDDDDKP

SEQ ID NO: 40 - protein, 8 aa, Artificial Sequence
  synthetic construct
DYKDDDDK

SEQ ID NO: 41 - protein, 16 aa, Artificial Sequence
  synthetic construct
TDKDMTITFTNKKDAE

SEQ ID NO: 42 - protein, 13 aa, Artificial Sequence
  Synthetic construct
AHIVMVDAYKPTK

SEQ ID NO: 43 - protein, 28 aa, Artificial Sequence
  Synthetic construct
KVAALKEKVAALKEKVAALKEKVAALKE

SEQ ID NO: 44 - protein, 28 aa, Artificial Sequence
  Synthetic construct
EVAALEKEVAALEKEVAALEKEVAALEK

SEQ ID NO: 45 - protein, 28 aa, Artificial Sequence
  Synthetic construct
EVSALEKEVSALEKEVSALEKEVSALEK

SEQ ID NO: 46 - protein, 28 aa, Artificial Sequence
  Synthetic construct
KVSALKEKVSALKEKVSALKEKVSALKE

SEQ ID NO: 47 - protein, 21 aa, Artificial Sequence
  Synthetic construct
EIAALEKEIAALEKEIAALEK

SEQ ID NO: 48 - protein, 28 aa, Artificial Sequence
  Synthetic construct
EIAALEKEIAALEKEIAALEKEIAALEK

SEQ ID NO: 49 - protein, 21 aa, Artificial Sequence
  Synthetic construct
KIAALKEKIAALKEKIAALKE

SEQ ID NO: 50 - protein, 28 aa, Artificial Sequence
  Synthetic construct
KIAALKEKIAALKEKIAALKEKIAALKE

SEQ ID NO: 51 - protein, 21 aa, Artificial Sequence
  Synthetic construct
EISALEKEISALEKEISALEK

SEQ ID NO: 52 - protein, 28 aa, Artificial Sequence
  Synthetic construct
EISALEKEISALEKEISALEKEISALEK

SEQ ID NO: 53 - protein, 21 aa, Artificial Sequence
  Synthetic construct
KISALKEKISALKEKISALKE

SEQ ID NO: 54 - protein, 28 aa, Artificial Sequence
  Synthetic construct
KISALKEKISALKEKISALKEKISALKE

SEQ ID NO: 55 - protein, 21 aa, Artificial Sequence
  Synthetic construct
EVAALEKEVAALEKEVAALEK

SEQ ID NO: 56 - protein, 21 aa, Artificial Sequence
  Synthetic construct
KVAALKEKVAALKEKVAALKE

SEQ ID NO: 57 - protein, 21 aa, Artificial Sequence
  Synthetic construct
EVSALEKEVSALEKEVSALEK

SEQ ID NO: 58 - protein, 21 aa, Artificial Sequence
  Synthetic construct
KVSALKEKVSALKEKVSALKE

SEQ ID NO: 59 - protein, 17 aa, Artificial Sequence
  Synthetic construct
QIEYLAKQIVDNAIQQA

SEQ ID NO: 60 - protein, 44 aa, Artificial Sequence
  Synthetic construct
SHIQIPPGLTELLQGYTVEVLRQQPPDLVEFAVEYFTRLREARA

SEQ ID NO: 61 - protein, 21 aa, Artificial Sequence
  Synthetic construct
CGQIEYLAKQIVDNAIQQAGC

SEQ ID NO: 62 - protein, 45 aa, Artificial Sequence
  Synthetic construct
CGHIQIPPGLTELLQGYTVEVLRQQPPDLVEFAVEYFTRLREARA

SEQ ID NO: 63 - DNA, 8835 bp, Artificial Sequence
  Synthetic CAR construct
caggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagattggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggttaacttttaaaagaaaaggggggattggggggtacagtgcaggggaaagaatagtagacataatagcaacagacatacaaactaaagaattacaaaaacaaattacaaaaattcaaaattttatcgagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattcggtaccgcggccgcccggggatccatggccttaccagtgaccgccttgctcctgccgctggccttgctgctccacgccgccaggccggacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaacagcctgcaaagcggcgactccgctcgctattactgcgttaccggactgtttgattattgggggcaggggacaactctgactgtttcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcc

SEQ ID NO: 64 - DNA, 723 bp, Artificial Sequence
  Synthetic construct
atggccttaccagtgaccgccttgctcctgccgctggccttgctgctccacgccgccaggccggaggttgctgccctggagaaggaggtggctgcactggagaaagaggtggccgccctggaaaaagaagtggcagccttggagaaggaaagcaagtatggcccaccttgtccaccttgtcccgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 65 - DNA, 723 bp, Artificial Sequence
  Synthetic construct
atggccttaccagtgaccgccttgctcctgccgctggccttgctgctccacgccgccaggccgaaagtggcagccctgaaggagaaagttgcggctctcaaagagaaagtggctgcactgaaagaaaaggttgccgccctcaaggaggaaagcaagtatggcccaccttgtccaccttgtcccgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 66 - protein, 464 aa, Artificial Sequence
  Synthetic CAR construct
DIVMTQTPLTLSVTFGQPASISCKSSQSLLDSDGQTYLNWLLQRPGQSPKRLIYLVSKLDSGVPDRFTGSGSGTDFTLKISRVEAEDLGVYYCWQGTHFPWTFGGGTKLEIKGGGGSGGGGSGGGGSEVQLQQSGAELVKPGASVKLSCTASGFNIKDYYMHWVKQRTEQGLEWIGRIDPEDGETKYAPKFQGKATITADTSSKTAYLQLSSLTSEDTAVYYCARLKGGYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 67 - protein, 432 aa, Artificial Sequence
  Synthetic CAR construct
DIVMTQTPLTLSVTFGQPASISCKSSQSLLDSDGQTYLNWLLQRPGQSPKRLIYLVSKLDSGVPDRFTGSGSGTDFTLKISRVEAEDLGVYYCWQGTHFPWTFGGGTKLEIKGGGGSGGGGSGGGGSEVQLQQSGAELVKPGASVKLSCTASGFNIKDYYMHWVKQRTEQGLEWIGRIDPEDGETKYAPKFQGKATITADTSSKTAYLQLSSLTSEDTAVYYCARLKGGYWGQGTTLTVSSESKYGPPCPPCPDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 68 - DNA, 1365 bp, Artificial Sequence
  Synthetic CAR construct
atggccttaccagtgaccgccttgctcctgccgctggccttgctgctccacgccgccaggccggacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaacagcctgcaaagcggcgactccgctcgctattactgcgttaccggactgtttgattattgggggcaggggacaactctgactgtttcctccgaaagcaagtatggcccaccttgtccaagctgtcccgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 69 - DNA, 1365 bp, Artificial Sequence
  Synthetic CAR construct
atggccttaccagtgaccgccttgctcctgccgctggccttgctgctccacgccgccaggccggacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaacagcctgcaaagcggcgactccgctcgctattactgcgttaccggactgtttgattattgggggcaggggacaactctgactgtttcctccgaaagcaagtatggcccaccttgtccaccttgtcccgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 70 - DNA, 1443 bp, Artificial Sequence
  Synthetic CAR construct
atggccttaccagtgaccgccttgctcctgccgctggccttgctgctccacgccgccaggccgcaggcggtagtcacccaggagccaagtctcacggtgagccccggcggtaccgtcacacttacatgcggaagctctaccggggctgtgaccacaagcaactacgcatcctgggtccagcagaaacccggtcaggctcctcggggcctcattggtgggacaaataacagagccccgggtgttcccgcccgattttctggcagtcttctgggaggaaaggccgctctgacaatatctggcgcacagcccgaagacgaggccgagtactattgcgtgttgtggtatagcgaccactgggtattcggtggaggaacaaagctgacagtgctcggcggtggagggagtggtggcggtggcagcggagggggcggatcacaagtgcaattgcaggagagtggacctggactcgtgaaaccatctgaaacactctccctgacttgtacggtttcagggttcctgctgacagactatggagtaaactggatcaggcagccacccggcaagggcttggagtggattggcgtcatttggggcgacggaatcaccgactataacccatcactcaaatctcgggtgaccatttccaaggataccagtaagaatcagttcagcctgaaactttcatccgtgacagctgcggacaccgccgtgtactactgtgtgacaggactttttgactactggggccaggggaccctggtgacagttagctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 71 - DNA, 1443 bp, Artificial Sequence
  Synthetic CAR construct
atggccttaccagtgaccgccttgctcctgccgctggccttgctgctccacgccgccaggccgcaggcggtagtcacccaggagccaagtctcacggtgagccccggcggtaccgtcacacttacatgcggaagctctaccggggctgtgaccacaagcaactacgcatcctgggtccagcagaaacccggtcaggcgccccggggcctcattggtgggacaaataacagagccccgggtgttcccgcccgattttctggcagtcttctgggaggaaaggccgctctgacaatatctggcgcacagcccgaagacgaggccgagtactattgcgtgttgtggtatagcgaccactgggtattcggtggaggaacaaagctgacagtgctcggcggtggagggagtggtggcggtggcagcggagggggcggatcacaagtgcaattgcaggagagtggacctggactcgtgaaaccatctgaaacactctccataacttgtacggtttcagggttcctgctgacagactatggagtaaactgggttaggcagccacccggcaagggcttggagtggctgggcgtcatttggggcgacggaatcaccgactataacccatcactcaaatctcggcttaccgtctccaaggatacgagtaagaatcaggtcagcctgaaaatgtcatccctcacagctgcggacaccgccgtgtactactgtgtgacaggactttttgactactggggccaggggaccctgctcacagttagctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 72 - DNA, 1443 bp, Artificial Sequence
  Synthetic CAR construct
atggccttaccagtgaccgccttgctcctgccgctggccttgctgctccacgccgccaggccgcaggcggtagtcacccaggagccaagtctcacggtgagccccggcggtaccgtcacacttacatgcggaagctctaccggggctgtgaccacaagcaactacgcatcctgggtccagcagaaacccggacaagcgttccggggcctcattggtgggacaaataacagagccccgggtgttcccgcccgattttctggcagtcttctgggaggaaaggccgctctgacaatatctggcgcacagcccgaagacgaggccgagtactattgcgtgttgtggtatagcgaccactgggtattcggtggaggaacaaagctgacagtgctcggcggtggagggagtggtggcggtggcagcggagggggcggatcacaagtgcaattgcaggagagtggacctggactcgtgaaaccatctgaaacactctccctcacttgtacggtttcagggttcctgctgacagactatggagtaaactggattaggcagccacccggcaagggcttggagtggatcggcgtcatttggggcgacggaatcaccgactataacccatcactcaaatctcgggtcaccatctccaaggataccagtaagaatcagttcagcctgaaactgtcatccgtcacagctgcggacaccgccgtgtactactgtgtgacaggactttttgactactggggccaggggaccctggtaacagttagctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 73 - DNA, 1443 bp, Artificial Sequence
  Synthetic CAR construct
atggccttaccagtgaccgccttgctcctgccgctggccttgctgctccacgccgccaggccgcaggcggtagtcacccaggagccaagtctcacggtgagccccggcggtaccgtcacacttacatgcggaagctctaccggggctgtgaccacaagcaactacgcatcctgggtccagcagaaacccggtcaggcattccggggcctcattggtgggacaaataacagagccccgggtgttcccgcccgattttctggcagtcttctgggaggaaaggccgctctgacaatatctggcgcacagcccgaagacgaggccgagtactattgcgtgttgtggtatagcgaccactgggtattcggtggaggaacaaagctgacagtgctcggcggtggagggagtggtggcggtggcagcggagggggcggatcacaagtgcaattgcaggagagtggacctggactcgtgaaaccatctgaaacactctccataacttgtacggtttcagggttcctgctgacagactatggagtaaactgggtcaggcagccacccggcaagggcttggagtggctcggcgtcatttggggcgacggaatcaccgactataacccatcactcaaatctcggttgaccgtgtccaaggataccagtaagaatcaggtcagcctgaaaatgtcatccctgacagctgcggacaccgccgtgtactactgtgtgacaggactttttgactactggggccaggggaccctgttgacagttagctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 74 - DNA, 1443 bp, Artificial Sequence
  Synthetic CAR construct
atggccttaccagtgaccgccttgctcctgccgctggccttgctgctccacgccgccaggccgcaggcggtagtcacccaggagccaagtctcacggtgagccccggcggtaccgtcacacttacatgcggaagctctaccggggctgtgaccacaagcaactacgcatcctgggtccagcagaaacccgatcacctgttccggggcctcattggtgggacaaataacagagccccgggtgttcccgcccgattttctggcagtcttctgggaggaaaggccgctctgacaatatctggcgcacagcccgaagacgaggccgagtactattgcgtgttgtggtatagcgaccactgggtattcggtggaggaacaaagctgacagtgctcggcggtggagggagtggtggcggtggcagcggagggggcggatcacaagtgcaattgcaggagagtggacctggactcgtgaaaccatctgaaacactctcccttacttgtacggtttcagggttcctgctgacagactatggagtaaactggatcaggcagccacccggcaagggcttggagtggatcggcgtcatttggggcgacggaatcaccgactataacccatcactcaaatctcgggtcaccatctccaaggatacgagtaagaatcagttcagcctgaaactctcatccgttacagctgcggacaccgccgtgtactactgtgtgacaggactttttgactactggggccaggggaccctggtaacagttagctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 75 - DNA, 1443 bp, Artificial Sequence
  Synthetic CAR construct
atggccttaccagtgaccgccttgctcctgccgctggccttgctgctccacgccgccaggccgcaggcggtagtcacccaggagccaagtctcacggtgagccccggcggtaccgtcacacttacatgcggaagctctaccggggctgtgaccacaagcaactacgcatcctgggtccagcagaaacccgaccatctgtttcggggcctcattggtgggacaaataacagagccccgggtgttcccgcccgattttctggcagtcttctgggaggaaaggccgctctgacaatatctggcgcacagcccgaagacgaggccgagtactattgcgtgttgtggtatagcgaccactgggtattcggtggaggaacaaagctgacagtgctcggcggtggagggagtggtggcggtggcagcggagggggcggatcacaagtgcaattgcaggagagtggacctggactcgtgaaaccatctgaaacactctccattacttgtacggtttcagggttcctgctgacagactatggagtaaactgggtgaggcagccacccggcaagggcttggagtggctcggcgtcatttggggcgacggaatcaccgactataacccatcactcaaatctcggttgaccgtgtccaaggataccagtaagaatcaggtgagcctgaaaatgtcatccctgacagctgcggacaccgccgtgtactactgtgtgacaggactttttgactactggggccaggggaccctgctgacagttagctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 76 - DNA, 1461 bp, Artificial Sequence
  Synthetic CAR construct
atggccttaccagtgaccgccttgctcctgccgctggccttgctgctccacgccgccaggccggacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaacagcctgcaaagcggcgactccgctcgctattactgcgttaccggactgtttgattattgggggcaggggacaactctgactgtttcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 77 - DNA, 1329 bp, Artificial Sequence
  Synthetic CAR construct
atggccttaccagtgaccgccttgctcctgccgctggccttgctgctccacgccgccaggccggacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaacagcctgcaaagcggcgactccgctcgctattactgcgttaccggactgtttgattattgggggcaggggacaactctgactgtttcctccgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 78 - DNA, 1374 bp, Artificial Sequence
  Synthetic CAR construct
atgggtgtccctacccagctcctgggactgctcctgctgtggatcaccgacgccatctgcgacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaattccctgcaaagcggcgactccgctcgctattactgcgttaccggactgtttgattattgggggcaggggacaactctgactgtttcctccgaaagcaagtatggcccaccttgtccaccttgtcccatttacatctgggcacccttggccggaatctgcgtggcccttctgctgtccttgatcatcactctcatctgcaaatggatcaggaaaaaattcccccacatattcaagcaaccatttaagaagaccactggagcagctcaagaggaagatgcttgtagctgccgatgtccacaggaagaagaaggaggaggaggaggctatgagctgagagccaagttcagcagatccgccgagacagccgccaacctgcaggatcccaaccagctgttcaacgagctgaacctgggcagacgggaggaattcgacgtgctggaaaagaagagagccagggaccccgagatgggcggcaagcagcagagaagaagaaaccctcaggaaggcgtctacaacgccctgcagaaagacaagatggccgaggcctacagcgagatcggcaccaagggcgagagaagaaggggcaagggccacgatggcctgttccagggcctgtccaccgccaccaaggacaccttcgacgccctgcacatgcagaccctggcccccagatga

SEQ ID NO: 79 - DNA, 1374 bp, Artificial Sequence
  Synthetic CAR construct
atgggtgtccctacccagctcctgggactgctcctgctgtggatcaccgacgccatctgcgacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaattccctgcaaagcggcgactccgctcgctattactgcgttaccggactgtttgattattgggggcaggggacaactctgactgtttcctccgaaagcaagtatggcccaccttgtccaccttgtcccatttacatctgggcacccttggccggaatctgcgtggcccttctgctgtccttgatcatcactctcatctgcaaatggatcaggaaaaaattcccccacatattcaagcaaccatttaagaagaccactggagcagctcaagaggaagatgcttgtagctgccgatgtccacaggaagaagaaggaggaggaggaggctatgagctgagagcaaaattcagcaggagtgcagagactgctgccaacctgcaggaccccaaccagctctacaatgagctcaatctagggcgaagagaggaatatgacgtcttggagaagaagcgggctcgggatccagagatgggaggcaaacagcagaggaggaggaacccccaggaaggcgtatacaatgcactgcagaaagacaagatggcagaagcctacagtgagatcggcacaaaaggcgagaggcggagaggcaaggggcacgatggcctttaccagggtctcagcactgccaccaaggacacctatgatgccctgcatatgcagaccctggcccctcgctaa

SEQ ID NO: 80 - DNA, 1467 bp, Artificial Sequence
  Synthetic CAR construct
atgggtgtccctacccagctcctgggactgctcctgctgtggatcaccgacgccatctgcgacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaattccctgcaaagcggcgactccgctcgctattactgcgttaccggactgtttgattattgggggcaggggacaactctgactgtttcctccactactaccaagccagtgctgcgaactccctcacctgtgcaccctaccgggacatctcagccccagagaccagaagattgtcggccccgtggctcagtgaaggggaccggattggacttcgcctgtgatatttacatctgggcacccttggccggaatctgcgtggcccttctgctgtccttgatcatcactctcatctgcaaatggatcaggaaaaaattcccccacatattcaagcaaccatttaagaagaccactggagcagctcaagaggaagatgcttgtagctgccgatgtccacaggaagaagaaggaggaggaggaggctatgagctgagagccaagttcagcagatccgccgagacagccgccaacctgcaggatcccaaccagctgttcaacgagctgaacctgggcagacgggaggaattcgacgtgctggaaaagaagagagccagggaccccgagatgggcggcaagcagcagagaagaagaaaccctcaggaaggcgtctacaacgccctgcagaaagacaagatggccgaggcctacagcgagatcggcaccaagggcgagagaagaaggggcaagggccacgatggcctgttccagggcctgtccaccgccaccaaggacaccttcgacgccctgcacatgcagaccctggcccccagatga

SEQ ID NO: 81 - DNA, 1467 bp, Artificial Sequence
  Synthetic CAR construct
atgggtgtccctacccagctcctgggactgctcctgctgtggatcaccgacgccatctgcgacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaattccctgcaaagcggcgactccgctcgctattactgcgttaccggactgtttgattattgggggcaggggacaactctgactgtttcctccactactaccaagccagtgctgcgaactccctcacctgtgcaccctaccgggacatctcagccccagagaccagaagattgtcggccccgtggctcagtgaaggggaccggattggacttcgcctgtgatatttacatctgggcacccttggccggaatctgcgtggcccttctgctgtccttgatcatcactctcatctgcaaatggatcaggaaaaaattcccccacatattcaagcaaccatttaagaagaccactggagcagctcaagaggaagatgcttgtagctgccgatgtccacaggaagaagaaggaggaggaggaggctatgagctgagagcaaaattcagcaggagtgcagagactgctgccaacctgcaggaccccaaccagctctacaatgagctcaatctagggcgaagagaggaatatgacgtcttggagaagaagcgggctcgggatccagagatgggaggcaaacagcagaggaggaggaacccccaggaaggcgtatacaatgcactgcagaaagacaagatggcagaagcctacagtgagatcggcacaaaaggcgagaggcggagaggcaaggggcacgatggcctttaccagggtctcagcactgccaccaaggacacctatgatgccctgcatatgcagaccctggcccctcgctaa

SEQ ID NO: 82 - DNA, 1371 bp, Artificial Sequence
  Synthetic CAR construct
atgggtgtccctacccagctcctgggactgctcctgctgtggatcaccgacgccatctgcgacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaacagcctgcaaagcggcgactccgctcgctattactgcgttaccggactgtttgattattgggggcaggggacaactctgactgtttcctccgaaagcaagtatggcccaccttgtccaccttgtcccttctgggccctggtggtggtggccggcgtgctgttctgttacggcctgctggtcacagtggccctgtgcgtgatctggaccaacagcagaagaaacagaggcggccagagcgactacatgaacatgacccccagaaggccaggcctgaccagaaagccctaccagccctacgcccctgccagagacttcgccgcctacagacccagagccaagttcagcagatccgccgagacagccgccaacctgcaggatcccaaccagctgttcaacgagctgaacctgggcagacgggaggaattcgacgtgctggaaaagaagagagccagggaccccgagatgggcggcaagcagcagagaagaagaaaccctcaggaaggcgtctacaacgccctgcagaaagacaagatggccgaggcctacagcgagatcggcaccaagggcgagagaagaaggggcaagggccacgatggcctgttccagggcctgtccaccgccaccaaggacaccttcgacgccctgcacatgcagaccctggcccccagatga

SEQ ID NO: 83 - DNA, 1371 bp, Artificial Sequence
  Synthetic CAR construct
atgggtgtccctacccagctcctgggactgctcctgctgtggatcaccgacgccatctgcgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaacagcctgcaaagcggcgactccgctcgctattactgcgttaccggactgtttgattattgggggcaggggacaactctgactgtttcctccggaggaggaggttcaggaggaggaggtagcgggggaggcggttccgggggaggcggttctgacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcgaaagcaagtatggcccaccttgtccaccttgtcccttctgggccctggtggtggtggccggcgtgctgttctgttacggcctgctggtcacagtggccctgtgcgtgatctggaccaacagcagaagaaacagaggcggccagagcgactacatgaacatgacccccagaaggccaggcctgaccagaaagccctaccagccctacgcccctgccagagacttcgccgcctacagacccagagccaagttcagcagatccgccgagacagccgccaacctgcaggatcccaaccagctgttcaacgagctgaacctgggcagacgggaggaattcgacgtgctggaaaagaagagagccagggaccccgagatgggcggcaagcagcagagaagaagaaaccctcaggaaggcgtctacaacgccctgcagaaagacaagatggccgaggcctacagcgagatcggcaccaagggcgagagaagaaggggcaagggccacgatggcctgttccagggcctgtccaccgccaccaaggacaccttcgacgccctgcacatgcagaccctggcccccagatga

SEQ ID NO: 84 - DNA, 1365 bp, Artificial Sequence
  Synthetic CAR construct
atgggtgtccctacccagctcctgggactgctcctgctgtggatcaccgacgccatctgcgacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaacagcctgcaaagcggcgactccgctcgctattactgcgttaccggactgtttgattattgggggcaggggacaactctgactgtttcctccgaaagcaagtatggcccaccttgtccaccttgtcccgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 85 - DNA, 326 bp, Artificial Sequence
  Synthetic CAR construct
  misc_feature (27)..(27): n is a, c, g, or t
  misc_feature (41)..(42): n is a, c, g, or t
  misc_feature (123)..(123): n is a, c, g, or t
  misc_feature (141)..(141): n is a, c, g, or t
  misc_feature (152)..(152): n is a, c, g, or t
  misc_feature (159)..(159): n is a, c, g, or t
  misc_feature (262)..(262): n is a, c, g, or t
  misc_feature (264)..(265): n is a, c, g, or t
  misc_feature (286)..(286): n is a, c, g, or t
  misc_feature (289)..(289): n is a, c, g, or t
davvtsatssgtvttcrsstgavttsnyaswvkdhtgggtnnragvarsgsgdkaattgatdaycvwysdhwvgggtktvgggggsggggsggggsggggsdvsggvassstctvsgtdygvnwvrsgkgwgvwgdgtdynsaksrsvtkdnsksvkmnssgdsaryycvtgdywggtttvsstttartatassracraaggavhtrgdacdywaagtcgvsvtyckrgrkkykmrvttdgcscrggcrvksrsadaaykgnynngrrydvdkrrgrdmggkrrkngynkdkmaaysgmkgrrrgkghdgygstatkdtydahmar

SEQ ID NO: 86 - DNA, 304 bp, Artificial Sequence
  Synthetic CAR construct
  misc_feature (27)..(27): n is a, c, g, or t
  misc_feature (41)..(42): n is a, c, g, or t
  misc_feature (123)..(123): n is a, c, g, or t
  misc_feature (141)..(141): n is a, c, g, or t
  misc_feature (152)..(152): n is a, c, g, or t
  misc_feature (159)..(159): n is a, c, g, or t
  misc_feature (240)..(240): n is a, c, g, or t
  misc_feature (242)..(243): n is a, c, g, or t
  misc_feature (264)..(264): n is a, c, g, or t
  misc_feature (267)..(267): n is a, c, g, or t
davvtsatssgtvttcrsstgavttsnyaswvkdhtgggtnnragvarsgsgdkaattgatdaycvwysdhwvgggtktvgggggsggggsggggsggggsdvsggvassstctvsgtdygvnwvrsgkgwgvwgdgtdynsaksrsvtkdnsksvkmnssgdsaryycvtgdywggtttvssskygccdywaagtcgvsvtyckrgrkkykmrvttdgcscrggcrvksrsadaaykgnynngrrydvdkrrgrdmggkrrkngynkdkmaaysgmkgrrrgkghdgygstatkdtydahmar

SEQ ID NO: 87 - DNA, 8892 bp, Artificial Sequence
  Synthetic CAR construct
caggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagattggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggttaacttttaaaagaaaaggggggattggggggtacagtgcaggggaaagaatagtagacataatagcaacagacatacaaactaaagaattacaaaaacaaattacaaaaattcaaaattttatcgagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattcggtaccgcggccgcccggggatccatggccttaccagtgaccgccttgctcctgccgctggccttgctgctccacgccgccaggccggatgttgttatgacccagaccccgctgtccctgcccgtttccctgggtgaccaggcgagtatctcttgccgttcctctcagtccctggttcacagtcagggtaacacctatctgcgctggtatctgcaaaaaccaggccagagccctaaagtgctgatttataaggtttcaaatcggtttagcggcgtcccggatcgcttctctgggagtggatcagggaccgactttacactgaaaattagccgcgtggaagcagaggatctgggcgtgtacttttgcagccagtccactcatgtgccgtggaccttcggcggtgggacaaaactggaaattaagcgtgcaggaggcggtgggagcggaggcggtgggtccggaggcggtgggtctggaggcggtgggagtggaggcggtgggtcaggcggtggtgggagcgaagtgaaactggatgagacaggaggaggtctggttcagccaggtcggcccatgaagctgtcctgtgtggcctctggctttaccttctccgactattggatgaactgggtccgtcagtctccggaaaaaggtctggagtgggtggcgcagattcggaacaagccctacaactacgaaacttactactctgatagtgttaaaggccgcttcaccatcagtcgtgatgactcaaaaagcagcgtttacctgcaaatgaacaatctgcgtgtcgaggacatgggcatctattactgcacaggctcctactatgggatggattattgggggcaggggacttcagttacagtttcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcc

SEQ ID NO: 88 - DNA, 8892 bp, Artificial Sequence
  Synthetic CAR construct
caggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagattggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggttaacttttaaaagaaaaggggggattggggggtacagtgcaggggaaagaatagtagacataatagcaacagacatacaaactaaagaattacaaaaacaaattacaaaaattcaaaattttatcgagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattcggtaccgcggccgcccggggatccatggccttaccagtgaccgccttgctcctgccgctggccttgctgctccacgccgccaggccggacattcagatgactcagagcccgtcttccctgtccgcttcagtgggtgaccgtgttaccattacctgccgtgcttctcagagcctggtgcactcccagggtaacacctatctgcggtggtatcagcagaaaccgggcaaggcccccaaagttctgatttataaggtctctaatcggtttagtggcgttccgtcacgcttctcaggtagcgggtccggaacagattttaccctgacaattagcagcctgcaaccggaagacttcgcaacctattactgccagcagtctacccatgtgccctggacatttggccagggtactaaggttgagctgaaacgtgctggaggtggaggaagcggaggtggaggcagcggcggtgggggatctggcggtgggggaagtggcggtgggggatcaggcggtgggggaagcgaagtccagctggtggagagtggaggtggactggtgcagccaggaggcagcctgcgtctgtcctgtgccgcgtctggctttaccttcagcgattactggatgaactgggtccgtcaggcaccaggaaagggcctggaatgggtggcgcagattcggaacaagccttacaactacgagacttactacgcggatagcgtgaagggtcgcttcaccatcagtcgtgacacatcaaagaacactgtttacctgcaaatgaacagcctgcgtgcagaagataccgctgtctattactgcacaggctcttattacggcatggactactggggccagggtactctggtgaccgtttctagtaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcc

SEQ ID NO: 89 - DNA, 8868 bp, Artificial Sequence
  Synthetic CAR construct
caggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagattggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggttaacttttaaaagaaaaggggggattggggggtacagtgcaggggaaagaatagtagacataatagcaacagacatacaaactaaagaattacaaaaacaaattacaaaaattcaaaattttatcgagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattcggtaccgcggccgcccggggatccatggccttaccagtgaccgccttgctcctgccgctggccttgctgctccacgccgccaggccggatgttgttatgacacagaccccgctgagtctgcccgtctccctgggcgaccaggcctccatttcttgccgtagttcacagtccctggtgcactctaacggaaatacctatctgcgctggtacctgcagaaaccgggccagagccccaaagtcctgatctataaggtgtccaaccgggtgtctggtgttccggatcgcttttcagggagcggcagcggcaccgacttcacactgaagatcaatcgtgttgaagcagaggatctgggcgtctacttttgctctcagagtacacatgtgccatggactttcggcggtgggaccaaactggaaattaagagctccgcagatgacgctaaaaaggacgccgcgaaaaaggatgacgccaaaaaggatgacgcgaaaaaggatggaggcgtcaaactggacgagaccggtgggggactggtgcagccgggcggtgcaatgaagctgagttgtgtgacttcaggttttaccttcgggcactattggatgaactgggttcgtcagagtccagaaaaaggtctggagtgggtcgctcagtttcggaacaagccttacaactacgaaacatactactcagatagcgttaaagggcgcttcactattagccgtgatgactccaagtctagtgtgtacctgcagatgaacaatctgcgggttgaggacacaggcatctattactgcacaggggcgtcctatggtatggagtatctggggcagggaacaagcgtcaccgtctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcc

SEQ ID NO: 90 - DNA, 8859 bp, Artificial Sequence
  Synthetic CAR construct
caggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagattggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggttaacttttaaaagaaaaggggggattggggggtacagtgcaggggaaagaatagtagacataatagcaacagacatacaaactaaagaattacaaaaacaaattacaaaaattcaaaattttatcgagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattcggtaccgcggccgcccggggatccatggccttaccagtgaccgccttgctcctgccgctggccttgctgctccacgccgccaggccgcaggttcagctggttgagagcggaggcaatctggttcagcccggtggtagtctgcgtctgtcttgtgcggcgtcagggttcactttcggtagtttttcaatgagctgggtccgtcaggcaccaggcggtgggctggaatgggtggcaggtctgtctgcacgtagctccctgacccactatgcagatagtgttaaagggcggttcacaatttcacgcgacaacgctaagaatagcgtctacctgcaaatgaactccctgcgggtcgaggataccgcagtgtattactgcgctcgccgttcttatgactctagtggatactggggccatttttatagctacatggatgtgtggggacagggcactctggtgaccgtttccggaggcggtgggtctggaggcggtgggagtggaggcggtgggtcaagcgttctgacccagccgtcctctgtcagcgccgcgccaggccagaaagtgacaatttcctgttctggaagtacttcaaacatcggcaacaattatgtttcctggtatcagcagcacccgggcaaagcgcccaagctgatgatttatgatgtgtctaaacgtccaagtggtgttcctgaccggttcagcggttccaagtctgggaatagtgcctcactggacatctcaggcctgcaaagcgaagatgaggcggactattactgcgcagcttgggatgacagcctgtccgaatttctgttcggcaccgggacaaagctgaccgtgctgggcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcc

SEQ ID NO: 91 - protein, 474 aa, Artificial Sequence
  Synthetic CAR construct
QVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 92 - protein, 442 aa, Artificial Sequence
  Synthetic CAR construct
QVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGESKYGPPCPPCPDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 93 - protein, 5 aa, Artificial Sequence
  Synthetic linker sequence
GGGGS

SEQ ID NO: 94 - protein, 4 aa, Artificial Sequence
  Synthetic linker sequence
GGGS

SEQ ID NO: 95 - protein, 3 aa, Artificial Sequence
  Synthetic linker sequence
GGS

SEQ ID NO: 96 - protein, 2 aa, Artificial Sequence
  Synthetic linker sequence
GS

SEQ ID NO: 97 - protein, 2 aa, Artificial Sequence
  Synthetic linker sequence
  MOD_RES (1)..(1): any amino acid
XS

SEQ ID NO: 98 - protein, 14 aa, Artificial Sequence
  Synthetic linker sequence
LVGEAAAKEAAAKA

SEQ ID NO: 99 - protein, 12 aa, Artificial Sequence
  Synthetic linker sequence
AEAAAKEAAAKA

SEQ ID NO: 100 - protein, 16 aa, Artificial Sequence
  Synthetic linker sequence
EAAAKEAAAKEAAAKA

SEQ ID NO: 101 - protein, 14 aa, Artificial Sequence
  Synthetic linker sequence
EGKSSGSGSESKST

SEQ ID NO: 102 - protein, 12 aa, Artificial Sequence
  Synthetic linker sequence
GSAGSAAGSGEF

SEQ ID NO: 103 - protein, 14 aa, Artificial Sequence
  Synthetic linker sequence
APAPAPAPAPAPAP

SEQ ID NO: 104 - DNA, 7028 bp, Artificial Sequence
  Synthetic CAR construct
tcgagaagcttgccaccatgggtgtccctacccagctcctgggactgctcctgctgtggatcaccgacgccatctgcgacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaacagcctgcaaagcggcgactccgctcgctattactgcgttaccggactgtttgattattgggggcaggggacaactctgactgtttcctccatcgagttcatgtacccccctccctacctggacaacgagagaagcaacggcaccatcatccacatcaaagaaaagcacctgtgccacacccagagcagccccaagctgttctgggccctggtggtggtggccggcgtgctgttctgttacggcctgctggtcacagtggccctgtgcgtgatctggaccaacagcagaagaaacagaggcggccagagcgactacatgaacatgacccccagaaggccaggcctgaccagaaagccctaccagccctacgcccctgccagagacttcgccgcctacagacccagagccaagttcagcagatccgccgagacagccgccaacctgcaggatcccaaccagctgttcaacgagctgaacctgggcagacgggaggaattcgacgtgctggaaaagaagagagccagggaccccgagatgggcggcaagcagcagagaagaagaaaccctcaggaaggcgtctacaacgccctgcagaaagacaagatggccgaggcctacagcgagatcggcaccaagggcgagagaagaaggggcaagggccacgatggcctgttccagggcctgtccaccgccaccaaggacaccttcgacgccctgcacatgcagaccctggcccccagatgagtcgacggtaccgcgggcccgggatccgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatccatcgatggagttcattatggacagcgcagaaagagctggggagaattgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgatttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcctagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttcggaacacccggccgcaaccctgggagacgtcccagggacttcgggggccgtttttgtggcccgacctgagtccaaaaatcccgatcgttttggactctttggtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtctgagaatatgggcccgggctagcctgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgcccccatatggccatatgagatcttatatggggcacccccgccccttgtaaacttccctgaccctgacatgacaagagttactaacagcccctctctccaagctcacttacaggctctctacttagtccagcacgaagtctggagacctctggcggcagcctaccaagaacaactggaccgaccggtggtacctcacccttaccgagtcggcgacacagtgtgggtccgccgacaccagactaagaacctagaacctcgctggaaaggaccttacacagtcctgctgaccacccccaccgccctcaaagtagacggcatcgcagcttggatacacgccgcccacgtgaaggctgccgaccccgggggtggaccatcctctagactgc

SEQ ID NO: 105 - protein, 14 aa, Artificial Sequence
  Synthetic GCN4 mutant
AYHLENEVARLKKL

SEQ ID NO: 106 - protein, 14 aa, Artificial Sequence
  Synthetic GCN4 mutant
AAHLENEVARLKKL

SEQ ID NO: 107 - protein, 14 aa, Artificial Sequence
  Synthetic GCN4 mutant
AAALENEVARLKKL

SEQ ID NO: 108 - protein, 14 aa, Artificial Sequence
  Synthetic GCN4 mutant
AAAAENEVARLKKL

SEQ ID NO: 109 - protein, 14 aa, Artificial Sequence
  Synthetic GCN4 mutant
NYHLENEVARLKKA

SEQ ID NO: 110 - protein, 14 aa, Artificial Sequence
  Synthetic GCN4 mutant
NYHLENEVARLKAA

SEQ ID NO: 111 - protein, 14 aa, Artificial Sequence
  Synthetic GCN4 mutant
NYHLENEVARLAAA

SEQ ID NO: 112 - protein, 14 aa, Artificial Sequence
  Synthetic GCN4 mutant
NYHLENEVARAAAA

SEQ ID NO: 113 - protein, 18 aa, Artificial Sequence
  Synthetic GCN4 mutant
LLPKNYHLENEVARLKKL

SEQ ID NO: 114 - protein, 18 aa, Artificial Sequence
  Synthetic GCN4 mutant
DLPQKYHLENEVARLKKL

SEQ ID NO: 115 - protein, 487 aa, Artificial Sequence
  Synthetic CAR construct
MALPVTALLLPLALLLHAARPDAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 116 - protein, 14 aa, Artificial Sequence
  Synthetic linker sequence
LVGEAAAKEAAAKA

SEQ ID NO: 117 - protein, 12 aa, Artificial Sequence
  Synthetic linker sequence
AEAAAKEAAAKA

SEQ ID NO: 118 - DNA, 15 bp, Artificial sequence
  Synthetic linker sequence
ggcgggggcggaagt

SEQ ID NO: 119 - DNA, 30 bp, Artificial Sequence
  Synthetic linker sequence
ggtgggggagggagcggtggaggtggttct

SEQ ID NO: 120 - protein, 12 aa, Artificial Sequence
  Synthetic linker sequence
AEAAAKEAAAKA

SEQ ID NO: 121 - DNA, 36 bp, Artificial Sequence
  Synthetic linker sequence
gcggaagcagccgccaaagaggctgccgcgaaagcg

SEQ ID NO: 122 - protein, 12 aa, Artificial Sequence
  Synthetic linker sequence
GSAGSAAGSGEF

SEQ ID NO: 123 - DNA, 36 bp, Artificial Sequence
  Synthetic linker sequence
ggttccgccggttccgcagccggctccggagagttc

SEQ ID NO: 124 - protein, 18 aa, Artificial Sequence
  Synthetic linker sequence
KESGSVSSEQLAQFRSLD

SEQ ID NO: 125 - DNA, 54 bp, Artificial Sequence
  Synthetic linker sequence
aaggaatccgggagcgtgtcttccgaacagctggctcagttccgcagcctggat

SEQ ID NO: 126 - protein, 14 aa, Artificial Sequence
  Synthetic linker sequence
EGKSSGSGSESKST

SEQ ID NO: 127 - DNA, 42 bp, Artificial Sequence
  Synthetic linker sequence
gaggggaagtcctccggctctgggtccgagtccaagtccaca

SEQ ID NO: 128 - protein, 14 aa, Artificial Sequence
  Synthetic linker sequence
APAPAPAPAPAPAP

SEQ ID NO: 129 - DNA, 42 bp, Artificial Sequence
  Synthetic linker sequence
gctcccgcccctgccccagctcctgcccccgcacccgcaccc

SEQ ID NO: 130 - protein, 2 aa, Artificial Sequence
  Synthetic linker sequence
GG

SEQ ID NO: 131 - DNA, 6 bp, Artificial Sequence
  Synthetic linker sequence
ggcggg

SEQ ID NO: 132 - protein, 18 aa, Artificial Sequence
  Synthetic linker sequence
GSTSGSGKPGSGEGSTKG

SEQ ID NO: 133 - protein, 18 aa, Artificial Sequence
  Synthetic linker sequence
GSTSGSGKPGSGEGSTKG

SEQ ID NO: 134 - protein, 13 aa, Artificial Sequence
  Synthetic linker sequence
ASTKGPSVFPLAP

SEQ ID NO: 135 - protein, 12 aa, Artificial Sequence
  Synthetic linker sequence
TVAAPSVFIFPP

SEQ ID NO: 136 - protein, 6 aa, Artificial Sequence
  Synthetic linker sequence
ASTKGP

SEQ ID NO: 137 - protein, 5 aa, Artificial Sequence
  Synthetic linker sequence
TVAAP

SEQ ID NO: 138 - protein, 14 aa, Artificial Sequence
  Synthetic GNC4 variant
NYHLENEVARLKKL

SEQ ID NO: 139 - protein, 18 aa, Artificial Sequence
  Synthetic GNC4 variant
LLPKNYHLENEVARLKKL

SEQ ID NO: 140 - protein, 18 aa, Artificial Sequence
  Synthetic GNC4 variant
DLPKQYHLENEVARLKKL

SEQ ID NO: 141 - protein, 16 aa, Artificial Sequence
  Synthetic GNC4 variant
LLPKNYHLENEVARLK

SEQ ID NO: 142 - protein, 15 aa, Artificial Sequence
  Synthetic GNC4 variant
LPKNYHLENEVARLK

SEQ ID NO: 143 - protein, 14 aa, Artificial Sequence
  Synthetic GNC4 variant
PKNYHLENEVARLK

SEQ ID NO: 144 - protein, 13 aa, Artificial Sequence
  Synthetic GNC4 variant
KNYHLENEVARLK

SEQ ID NO: 145 - protein, 12 aa, Artificial Sequence
  Synthetic GNC4 variant
NYHLENEVARLK

SEQ ID NO: 146 - protein, 13 aa, Artificial Sequence
  Synthetic GNC4 variant
NYHLENEVARLKA

SEQ ID NO: 147 - protein, 18 aa, Artificial Sequence
  Synthetic GNC4 variant
LLPKNYHLENEVARLKAL

SEQ ID NO: 148 - protein, 15 aa, Artificial Sequence
  Synthetic GNC4 variant
KNYHLENEVARLKAL

SEQ ID NO: 149 - protein, 14 aa, Artificial Sequence
  Synthetic GNC4 variant
NYHLENEVARLKAL

SEQ ID NO: 150 - protein, 14 aa, Artificial Sequence
  Synthetic GNC4 variant
NYHLENEVARLKGL

SEQ ID NO: 151 - protein, 14 aa, Artificial Sequence
  Synthetic GNC4 variant
NYHLENEVARLKAA

SEQ ID NO: 152 - protein, 15 aa, Artificial Sequence
  Synthetic GNC4 variant
KNYHLENEVARLKGL

SEQ ID NO: 153 - protein, 15 aa, Artificial Sequence
  Synthetic GNC4 variant
KNYHLENEVARLKAA

SEQ ID NO: 154 - protein, 15 aa, Artificial Sequence
  Synthetic GNC4 variant
KNYHLENEVARLKKL

SEQ ID NO: 155 - protein, 15 aa, Artificial Sequence
  Synthetic GNC4 variant
KNYHLENEVARLKAL

SEQ ID NO: 156 - protein, 15 aa, Artificial Sequence
  Synthetic GNC4 variant
KNYHLENEVARLKGL

SEQ ID NO: 157 - protein, 15 aa, Artificial Sequence
  Synthetic GNC4 variant
KNYHLENEVARLKAA

SEQ ID NO: 158 - protein, 15 aa, Artificial Sequence
  Synthetic GNC4 variant
KNYHLENEVARLKGG

SEQ ID NO: 159 - protein, 14 aa, Artificial Sequence
  Synthetic GNC4 variant
NYHLENEVARLKKL

SEQ ID NO: 160 - protein, 14 aa, Artificial Sequence
  Synthetic GNC4 variant
NYHLENEVARLKAL

SEQ ID NO: 161 - protein, 14 aa, Artificial Sequence
  Synthetic GNC4 variant
NYHLENEVARLKGL

SEQ ID NO: 162 - protein, 14 aa, Artificial Sequence
  Synthetic GNC4 variant
NYHLENEVARLKAA

SEQ ID NO: 163 - protein, 14 aa, Artificial Sequence
  Synthetic GNC4 variant
NYHLENEVARLKGG

SEQ ID NO: 164 - protein, 16 aa, Artificial Sequence
  Synthetic linker sequence
EAAAKEAAAKEAAAKA

SEQ ID NO: 165 - protein, 45 aa, Artificial Sequence
  Synthetic hinge sequence
TTTPAPRPPTPAPTIASQPLSLRPEACRPAAGGAVHTRGLDFACD

SEQ ID NO: 166 - protein, 1 aa, Artificial Sequence
  Synthetic hinge sequence
D

SEQ ID NO: 167 - protein, 12 aa, Artificial Sequence
  Synthetic hinge sequence
ESKYGPPCPSCP

SEQ ID NO: 168 - protein, 12 aa, Artificial Sequence
  Synthetic hinge sequence
ESKYGPPCPPCP

SEQ ID NO: 169 - protein, 237 aa, Artificial Sequence
  Made in lab - humanized GCN4 scFv
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSLTCTVSGFLLTDYGVNWIRQPPGKGLEWIGVIWGDGITDYNPSLKSRVTISKDTSKNQFSLKLSSVTAADTAVYYCVTGLFDYWGQGTLVTVSS

SEQ ID NO: 170 - protein, 237 aa, Artificial Sequence
  Made in lab - humanized GCN4 scFv
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTAVYYCVTGLFDYWGQGTLLTVSS

SEQ ID NO: 171 - protein, 237 aa, Artificial Sequence
  Made in lab - humanized GCN4 scFv
QAVVTQEPSLTVSPGGTVTLTCGSSTGAVTTSNYASWVQQKPGQAFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSLTCTVSGFLLTDYGVNWIRQPPGKGLEWIGVIWGDGITDYNPSLKSRVTISKDTSKNQFSLKLSSVTAADTAVYYCVTGLFDYWGQGTLVTVSS

SEQ ID NO: 172 - protein, 237 aa, Artificial Sequence
  Made in lab - humanized GCN4 scFv
QAVVTQEPSLTVSPGGTVTLTCGSSTGAVTTSNYASWVQQKPGQAFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTAVYYCVTGLFDYWGQGTLLTVSS

SEQ ID NO: 173 - protein, 237 aa, Artificial Sequence
  Made in lab - humanized GCN4 scFv
QAVVTQEPSLTVSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSLTCTVSGFLLTDYGVNWIRQPPGKGLEWIGVIWGDGITDYNPSLKSRVTISKDTSKNQFSLKLSSVTAADTAVYYCVTGLFDYWGQGTLVTVSS

SEQ ID NO: 174 - protein, 237 aa, Artificial Sequence
  Made in lab - humanized GCN4 scFv
QAVVTQEPSLTVSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTAVYYCVTGLFDYWGQGTLLTVSS

SEQ ID NO: 175 - DNA, 1443 bp, Artificial Sequence; identical to SEQ ID NO: 70
  Made in lab - humanized GCN4 scFv

SEQ ID NO: 176 - DNA, 1443 bp, Artificial Sequence; identical to SEQ ID NO: 71
  Made in lab - humanized GCN4 scFv

SEQ ID NO: 177 - DNA, 1443 bp, Artificial Sequence; identical to SEQ ID NO: 72
  Made in lab - humanized GCN4 scFv

SEQ ID NO: 178 - DNA, 1443 bp, Artificial Sequence; identical to SEQ ID NO: 73
  Made in lab - humanized GCN4 scFv

SEQ ID NO: 179 - DNA, 1443 bp, Artificial Sequence; identical to SEQ ID NO: 74
  Made in lab - humanized GCN4 scFv

SEQ ID NO: 180 - DNA, 1443 bp, Artificial Sequence; identical to SEQ ID NO: 75
  Made in lab - humanized GCN4 scFv

SEQ ID NO: 181 - DNA, 1329 bp, Artificial Sequence; identical to SEQ ID NO: 77
  Synthetic CAR construct

SEQ ID NO: 182 - DNA, 1365 bp, Artificial Sequence; identical to SEQ ID NO: 68
  Synthetic CAR construct

SEQ ID NO: 183 - DNA, 1365 bp, Artificial Sequence; identical to SEQ ID NO: 69
  Synthetic CAR construct

SEQ ID NO: 184 - DNA, 642 bp, Artificial Sequene
  Made in Lab - antibody fragment
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagcttgagatcaaacgaactgtggctgcaccatctgtcttcatcttcccgccatctgatgagcagttgaaatctggaactgcctctgtcgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgtcctcgcccgtcacaaagagcttcaacaggggagagtgt

SEQ ID NO: 185 - DNA, 669 bp, Artificial Sequence
  Made in Lab - antibody fragment
gaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgactgtgccctctagcagcttgggcacccagacctacatctgcaacgtgaatcacaagcccagcaacaccaaggtggacaagaaagttgagcccaaatcttgt

SEQ ID NO: 186 - DNA, 1347 bp, Artificial Sequence
  Made in Lab - antibody fragment
gaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgactgtgccctctagcagcttgggcacccagacctacatctgcaacgtgaatcacaagcccagcaacaccaaggtggacaagaaagttgagcccaaatcttgtgacaaaactcacacatgcccaccgtgcccagcacctccagtcgccggaccgtcagtcttcctcttccctccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaaggcctcccaagctccatcgagaaaaccatctccaaagccaaagggcagccccgagaaccacaggtgtacaccctgcctccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 187 - DNA, 711 bp, Artificial Sequence
  Made in Lab - antibody fragment
atgaaaaagaatatcgcatttcttcttgctagcatgttcgttttttctattgctacaaacgcatacgctgacatccagatgacccagtctccatcctccctgtctgcatctgtaggagacagagtcaccatcacttgccgggcaagtcaggatgtgaataccgcggtcgcatggtatcagcagaaaccagggaaagcccctaagctcctgatctattctgcatccttcttgtatagtggggtcccatcaaggttcagtggcagtagatctgggacagatttcactctcaccatcagcagtctgcaacctgaagattttgcaacttactactgtcaacagcattacactacccctccgacgttcggccaaggtaccaagcttgagatcaaacgaactgtggctgcaccatctgtcttcatcttcccgccatctgatgagcagttgaaatctggaactgcctctgtcgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgtcctcgcccgtcacaaagagcttcaacaggggagagtgt

SEQ ID NO: 188 - DNA, 753 bp, Artificial Sequence
  Made in Lab - antibody fragment
atgaaaaagaatatcgcatttcttcttgcatctatgttcgttttttctattgctacaaacgcgtacgctgaggtgcagctggtggagtctggaggaggcttggtccagcctggggggtccctgagactctcctgtgcagcctctgggttcaatattaaggacacttacatccactgggtccgccaggctccagggaaggggctggagtgggtcgcacgtatttatcctaccaatggttacacacgctacgcagactccgtgaagggccgattcaccatctccgcagacacttccaagaacacggcgtatcttcaaatgaacagcctgagagccgaggacacggccgtgtattactgttcgagatggggcggtgacggcttctatgccatggactactggggccaaggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgactgtgccctctagcagcttgggcacccagacctacatctgcaacgtgaatcacaagcccagcaacaccaaggtggacaagaaagttgagcccaaatcttgtgacaaaactcacaca

SEQ ID NO: 189 - DNA, 708 bp, Artificial Sequence
  Made in Lab - antibody fragment
atgaaaaagaatatcgcatttcttcttgctagcatgttcgttttttctattgctacaaacgcatacgctcagattgtgctgagccagagcccggcgattctgagcgcgagcccgggcgaaaaagtgaccatgacctgccgcgcgagcagcagcgtgagctatattcattggtttcagcagaaaccgggcagcagcccgaaaccgtggatttatgcgaccagcaacctggcgagcggcgtgccggtgcgctttagcggcagcggcagcggcaccagctatagcctgaccattagccgcgtggaagcggaagatgcggcgacctattattgccagcagtggaccagcaacccgccgacctttggcggcggcaccaagcttgagatcaaacgaactgtggctgcaccatctgtcttcatcttcccgccatctgatgagcagttgaaatctggaactgcctctgtcgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgtcctcgcccgtcacaaagagcttcaacaggggagagtgt

SEQ ID NO: 190 - DNA, 756 bp, Artificial Sequence
  Made in Lab - antibody fragment
atgaaaaagaatatcgcatttcttcttgcatctatgttcgttttttctattgctacaaacgcgtacgctcaggtgcagctgcagcagccgggcgcggaactggtgaaaccgggcgcgagcgtgaaaatgagctgcaaagcgagcggctatacctttaccagctataacatgcattgggtgaaacagaccccgggccgcggcctggaatggattggcgcgatttatccgggcaacggcgataccagctataaccagaaatttaaaggcaaagcgaccctgaccgcggataaaagcagcagcaccgcgtatatgcagctgagcagcctgaccagcgaagatagcgcggtgtattattgcgcgcgcagcacctattatggcggcgattggtattttaacgtgtggggcgcgggcaccaccgtgaccgtgagcgcggcgagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgactgtgccctctagcagcttgggcacccagacctacatctgcaacgtgaatcacaagcccagcaacaccaaggtggacaagaaagttgagcccaaatcttgtgacaaaactcacaca

SEQ ID NO: 191 - DNA, 708 bp, Artificial Sequence
  Made in Lab - antibody fragment
atgagggtccccgctcagctcctggggctcctgctgctctggctcccaggtgcacgatgtgacatcctgctgacccagtcccccgtgatcctgtccgtgtcccctggcgagcgggtgtccttctcctgccgggcctcccagtccatcggcaccaacatccactggtatcagcagcggaccaacggctcccctcggctgctgatcaagtacgcctccgagtctatctccggcatcccttcccggttctccggctccggctctggcaccgacttcaccctgtccatcaactccgtggagtccgaggatatcgccgactactactgccagcagaacaacaactggcctaccaccttcggcgctggaaccaagctggagctgaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttgatga

SEQ ID NO: 192 - DNA, 753 bp, Artificial Sequence
  Made in Lab - antibody fragment
atgggttggagcctcatcttgctcttccttgtcgctgttgctacgcgtgtccactcccaggtgcagctgaagcagtccggccctggcctggtgcagccttcccagtccctgtccatcacctgcaccgtgtccggcttctccctgaccaactacggcgtgcactgggtgcgccagtcccccggcaagggcctggagtggctgggcgtgatctggtccggcggcaacaccgactacaacacccctttcacctcccggctgtccatcaacaaggacaactccaagtcccaggtgttcttcaagatgaactccctgcagtccaacgacaccgccatctactactgcgccagagccctgacctactatgactacgagttcgcctactggggccagggcaccctggtgaccgtgtccgccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgccca

SEQ ID NO: 193 - DNA, 678 bp, Artificial Sequence
  Made in Lab - antibody fragment
gatatccagctgcaggagtccggaccaggtctggtgaagcccagccagtccctgtctctgacctgcagcgtcactggctattccatcaccagtgcatactattggaactggatcagacagttccctggaaacaaactggagtggatggggtacatctcttacgacggtagaaacaactacaaccccagcctcaaaaacaggattagcattacccgcgacactagtaagaaccagtttttcctgaagctcaacagtgtgacaactgaggacactgctacttattattgtgccaaggagggcgactatgatgtcggcaattattacgctatggactattggggtcaggggactagcgtgaccgtcagttctgccaggaccaaaggaccgtccgtctttcctctggccccttcctctaagtccacaagcggtgggaccgcagcactgggatgcctggtgaaggattacttccctgagccggtgaccgtgtcctggaactccggagctctcacctccggtgtccatacctttcctgccgtcctgcagtcctccggcctgtacagcctctctagcgtcgtgactgtgccctccagctccctgggcacccaaacttatatctgcaatgttaaccacaagccttctaataccaaggtcgacaagaaagtggagccgaagagctgt

SEQ ID NO: 194 - DNA, 645 bp, Artificial Sequence
  Made in Lab - antibody fragment
gaaaacgtgctcacccagagtcccgccatcatgagcgccagtcccggcgagaaggtgaccatgacctgtagggcctcttccaatgtgatctctagctacgtgcattggtaccagcagcgtagtggggccagccctaagctctggatttactccacctccaacctggcctccggggtccccgcccgtttctctggcagtggctctggtacctcttactccctgactatcagcagcgtcgaggccgaggatgccgctacatactactgtcagcagtacagtggataccctctgaccttcggggctggcaccaagctggagctgaagcgcgctgccgccgcccccagtgtcttcattttccccccttccgatgagcagctgaagagcggtacagcctctgttgtttgtctgctgaacaacttctatccacgcgaggccaaggtgcagtggaaagttgataacgcgctgcagagtggcaactcccaggagtctgtgacagagcaggacagtaaagacagcacatattccctgtctagcacactgactctgtccaaggctgactatgagaagcacaaggtgtacgcttgcgaggtcacccaccagggactgagttctcctgtgaccaagtccttcaatcgcggcgagtgt

SEQ ID NO: 195 - DNA, 654 bp, Artificial Sequence
  Made in Lab - antibody fragment
gatattcagatgacccagagcccgagcagcctgagcgcgagcgtgggcgatcgcgtgaccattacctgccgcgcgagcgaaagcgtggataactatggcattagctttatgaactggtttcagcagaaaccgggcaaagcgccgaaactgctgatttatgcggcgagcaaccagggcagcggcgtgccgagccgctttagcggcagcggcagcggcaccgattttaccctgaacattagcagcctgcagccggatgattttgcgacctattattgccagcagagcaaagaagtgccgtggacctttggccagggcaccaaagtggaaattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 196 - DNA, 690 bp, Artificial Sequence
  Made in Lab - antibody fragment
caggtgcagctggtgcagagcggcgcggaagtgaaaaaaccgggcagcagcgtgaaagtgagctgcaaagcgagcggctatacctttaccgattataacatgcattgggtgcgccaggcgccgggccagggcctggaatggattggctatatttatccgtataacggcggcaccggctataaccagaaatttaaaagcaaagcgaccattaccgcggatgaaagcaccaacaccgcgtatatggaactgagcagcctgcgcagcgaagataccgcggtgtattattgcgcgcgcggccgcccggcgatggattattggggccagggcaccctggtgaccgtgagcagcgcctccaccaagggcccatcggtcttccccctggcaccctcctcctagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtggtggcggtcaccatcaccatcatcaccaccac

SEQ ID NO: 197 - protein, 107 aa, Artificial Sequence
  Made in Lab - antibody fragment
DIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKLEIK

SEQ ID NO: 198 - protein, 222 aa, Artificial Sequence
  Made in Lab - antibody fragment
EVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 199 - protein, 214 aa, Artificial Sequence
  Made in Lab - antibody fragment
DIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 200 - protein, 217 aa, Artificial Sequence
  Made in Lab - antibody fragment
QLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 201 - protein, 214 aa, Artificial Sequence
  Made in Lab - antibody fragment
DIQMTQSPSSLSASVGDRVTITCRANQGISNNLNWYQQKPGKAPKPLIYYTSNLQSGVPSRFSGSGSGTDYTLTISSLQPEDFATYYCQQFTSLPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 202 - protein, 224 aa, Artificial Sequence
  Made in Lab - antibody fragment
EVQLVESGGGLVQPGGSLRLSCAASGFTFSNFDMAWVRQAPGKGLVWVSSITTGGGDTYYADSVKGRFTISRDNAKSTLYLQMDSLRSEDTAVYYCVRHGYYDGYHLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 203 - protein, 214 aa, Artificial Sequence
  Made in Lab - antibody fragment
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204 - protein, 449 aa, Artificial Sequence
  Made in Lab - antibody fragment
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - protein, 223 aa, Artificial Sequence
  Made in Lab - antibody fragment
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 206 - protein, 450 aa, Artificial Sequence
  Made in Lab - antibody fragment
EVQLVESGGGLVQPGGSLRLSCAASGFTFSNFDMAWVRQAPGKGLVWVSSITTGGGDTYYADSVKGRFTISRDNAKSTLYLQMDSLRSEDTAVYYCVRHGYYDGYHLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 207 - DNA, 4137 bp, Artificial Sequence
  Made in Lab - antibody fragment
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcggacattcagctgacccagtctccagcttccctgtctacatctctgggagaaactgtcaccatccaatgtcaagcaagtgaggacatttacagtggtttagcgtggtatcagcagaagccagggaaatctcctcagctcctgatctatggtgcaagtgacttacaagacggcgtcccatcacgattcagtggcagtggatctggcacacagtattctctcaagatcaccagcatgcaaactgaagatgaaggggtttatttctgtcaacagggtttaacgtatcctcggacgttcggtggcggcaccaagctggaaatcaaacgaactgtggctgcaccatctgtcttcatcttcccgccatctgatgagcagttgaaatctggaactgcctctgtcgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgtcctcgcccgtcacaaagagcttcaacaggggagagtgttgataagtgctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 208 - DNA, 4152 bp, Artificial Sequence
  Made in Lab - antibody fragment
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcgcaagtgcagctggtgcagtctggggctgagcttgtgagacctgggacctctgtgaagttatcttgcaaagtttctggcgataccattacattttactacatgcactttgtgaagcaaaggcctggacagggtctggaatggataggaaggattgatcctgaggatgaaagtactaaatattctgagaagttcaaaaacaaggcgacactcactgcagatacatcttccaacacagcctacctgaagctcagcagcctgacctctgaggacactgcaacctatttttgtatctacggaggatactactttgattactggggcccaggaaccatggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgactgtgccctctagcagcttgggcacccagacctacatctgcaacgtgaatcacaagcccagcaacaccaaggtggacaagaaagttgagcccaaatcttgttgataagtgctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 209 - DNA, 681 bp, Artificial Sequence
  Made in Lab - antibody fragment
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaagtgactggggatctcgaggatgcttttgatatctggggccaagggacaatggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgactgtgccctctagcagcttgggcacccagacctacatctgcaacgtgaatcacaagcccagcaacaccaaggtggacaagaaagttgagcccaaatcttgt

SEQ ID NO: 210 - DNA, 642 bp, Artificial Sequence
  Made in Lab - antibody fragment
gacatccagatgacccagtctccatcgtccctgtctgcatctgtaggagacagagtcaccatcacttgccgggcaagccagaccatttggagctacttaaattggtatcagcagagaccagggaaagcccctaacctcctgatctatgctgcatccagtttgcaaagtggggtcccatcaaggttcagtggcaggggatctgggacagatttcactctcaccatcagcagtctgcaagctgaagattttgcaacttactactgtcaacagagttacagtatccctcagacttttggccaggggaccaagctggagatcaaacgaactgtggctgcaccatctgtcttcatcttcccgccatctgatgagcagttgaaatctggaactgcctctgtcgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgtcctcgcccgtcacaaagagcttcaacaggggagagtgt

SEQ ID NO: 211 - DNA, 660 bp, Artificial Sequence
  Made in Lab - antibody fragment
gaggtgcaactcgttcagagcgggggcggcgtcgtcaggcctggcggctccctccgtctgccttgtgctgcctccggctttaccttcgacgattacggaatgtcctgggttcgccaggctcctggcaagggtctggagtgggtctctggcatcaactggaatggcggcagcaccggttatgctgacagtgtgaaggggaggttcacaattagccgggacaatgccaagaacagcctgtacctgcagatgaactccctgcgtgctgaggacaccgctctgtatcactgcgcgagaggcggtgacgacgcctttgacatttggggccagggtaccatggttacagtgagctctgctagcaccaagggcccgagcgtcttccctctggcccccagctctaaatctacttccgggggcaccgccgccctcgggtgcctggtgaaggactatttccctgagcctgtgacagtgagctggaactccggagcattgacttctggtgtgcacactttccccgctgtgctgcagtcctctggactgtattccctgtcctccgtggtgactgtcccaagctcctctctggggacacagacatacatctgtaatgtgaaccacaaaccgtccaacactaaggtggacaagaaagtggaaccaaagtcttgt

SEQ ID NO: 212 - DNA, 645 bp, Artificial Sequence
  Made in Lab - antibody fragment
cggatcgttatgacacagtccccgggcaccctgagcgtcagccccggagagaccgctacactctcctgcagggcctcccagtcttttagcaacatgctcgcgtggtaccaacagaagagcggacaaccacctcgcctgctcatttatggcgtttctacccgggcagctggggtgcctgcgcggttctctggctccgggtccggaactgagtttactctgacaattagcaacctccaatccgaggactttgctgtctactactgtcaacaatacggagactggccgcgctacacctttggccaagggactaaagtggaaagaaagcgtacagttgccgctcctagcgtcttcatcttccccccctctgatgagcagttgaagtccggaaccgcctccgtggtgtgtctgctgaacaacttctacccccgcgaggctaaggtgcagtggaaggtcgataacgccttgcaatctgggaactctcaggaaagcgtgacagagcaggactccaaagacagcacctatagcctgagctctactctgaccctgagcaaggctgactacgagaaacataaggtttacgcatgcgaggtgacccaccagggactgagtagtcctgtcaccaagagtttcaatcgtggcgaatgt

SEQ ID NO: 213 - DNA, 672 bp, Artificial Sequence
  Made in Lab - antibody fragment
gaagtgcaactgcagcagtccgggactgtgctggcccgtcccggagcaagcgtcaagatgagctgtaaggcgtctgggtacaggttcaccaattactggatccactgggtgaaacaaaggccaggtcagggtctggaatggattggtggcatcaacccaggaaataactataccacttacaaacgtaacctgaaaggcaaggccaccctgactgccgttacaagcgccagcactgcttatatggatctgagcagtctcacctccgaggattccgctgtgtactactgcacacgcgaaggctacggtaactatggcgcctggttcgcctactggggccagggcaccttggttaccgtgtcctctgcgtccaccaagggaccaagcgtgtttcccctcgccccaagcagcaagagcacttctggcggcactgcggctttgggctgcctggtcaaagattactttcccgagcccgttaccgtgagctggaactccggagctctgacctccggcgttcatacctttccggcggtgctgcagtcctctggcctgtattctctgtcctctgtcgtcaccgttccttcctcctccctcggaacccaaacctacatctgtaacgtgaaccacaaaccctctaacacaaaggttgacaagaaggttgagccaaaatcctgt

SEQ ID NO: 214 - DNA, 657 bp, Artificial Sequence
  Made in Lab - antibody fragment
gatgtggtcgtgacccagactccactgtctctgcctgtgagtttcggtgaccaagtcagcatttcttgcagaagttctcaatccctggctaactcttacggtaacacctttctgtcttggtatctggacaaacctggcgagagccctcagctgctgatctacggcatcagcaaccggttcagcggtgtccccgaccgcttcaccggttctggctccggcactgacttcacactgaagatctctactatcaaaccagaagacttgggcatgtactattgtttggaaggcacccaccagccatatactttcggtggcggcacaaagctggagatcaaacgcaccgtcgccgccccttccgtgttcatctttcctccttccgacgaacagctgaagagtggcacagcatctgtggtctgcctgctgaacaatttctaccctagagaggccaaggtccagtggaaggtggacaatgcactccagtccgggaactctcaggagagtgtgacagagcaggattctaaggattccacttactccctgagctctacattgactctgtccaaagccgactacgaaaagcataaggtttacgcgtgtgaagtgacccaccagggcctgtccagccctgtgaccaagagttttaaccggggggagtgc

SEQ ID NO: 215 - DNA, 672 bp, Artificial Sequence
  Made in Lab - antibody fragment
caggtgcagctgcagcagccgggcgcggaactggtgaaaccgggcgcgagcgtgaaaatgagctgcaaagcgagcggctatacctttaccagctataacatgcattgggtgaaacagaccccgggccgcggcctggaatggattggcgcgatttatccgggcaacggcgataccagctataaccagaaatttaaaggcaaagcgaccctgaccgcggataaaagcagcagcaccgcgtatatgcagctgagcagcctgaccagcgaagatagcgcggtgtattattgcgcgcgcagcacctattatggcggcgattggtattttaacgtgtggggcgcgggcaccaccgtgaccgtgagcgcggcgagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgactgtgccctctagcagcttgggcacccagacctacatctgcaacgtgaatcacaagcccagcaacaccaaggtggacaagaaagttgagcccaaatcttgt

SEQ ID NO: 216 - DNA, 639 bp, Artificial Sequence
  Made in Lab - antibody fragment
cagattgtgctgagccagagcccggcgattctgagcgcgagcccgggcgaaaaagtgaccatgacctgccgcgcgagcagcagcgtgagctatattcattggtttcagcagaaaccgggcagcagcccgaaaccgtggatttatgcgaccagcaacctggcgagcggcgtgccggtgcgctttagcggcagcggcagcggcaccagctatagcctgaccattagccgcgtggaagcggaagatgcggcgacctattattgccagcagtggaccagcaacccgccgacctttggcggcggcaccaagcttgagatcaaacgaactgtggctgcaccatctgtcttcatcttcccgccatctgatgagcagttgaaatctggaactgcctctgtcgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgtcctcgcccgtcacaaagagcttcaacaggggagagtgt

SEQ ID NO: 217 - DNA, 666 bp, Artificial Sequence
  Made in Lab - antibody fragment
caagtgcagctcgtgcagagtggcgcagaggtgaagaaacctggctcaagtgttaaggtgtcctgtaaggctagtggctacgctttttcttacagttggatcaactgggttcgccaagcccccgggcagggattggaatggatgggcaggatctttccaggcgatggagacactgactataacggcaagtttaagggcagggtgacaatcacggcggacaaaagcacaagcactgcctacatggagctgagctcactgcggtcagaggacacggctgtatattactgcgccaggaacgtgttcgatggctactggctggtgtattgggggcagggcacgcttgtgactgttagcagcgcaagtactaagggtccatcagtgttcccactggctccatcctctaagtcaacgtctggcggtacagcagctcttggctgtctcgttaaggactattttccggagcctgtgaccgtcagttggaattctggcgcactgacgtcaggagtgcatacttttcctgccgtcctgcagagttccggactgtacagcctttcctccgtcgtgactgttccatccagcagcctgggaacccagacctatatttgtaacgtgaaccacaagccctcaaacaccaaggttgacaagaaggtggagcctaagagttgt

SEQ ID NO: 218 - DNA, 666 bp, Artificial Sequence
  Made in Lab - antibody fragment
gatatagtaatgacacaaacgcctctgtctcttcctgtcacgcccggcgaaccagcctccatatcctgcagatcatctaaaagtcttctccactccaacggaattacgtatttgtactggtatttgcagaagcctgggcagtctccccaactgctgatttatcagatgtctaacttggtaagcggggtgcccgataggttttcagggtccggaagcggcacagatttcacgctgaagatcagcagagtggaagccgaggacgtgggcgtgtattattgcgcgcagaatttggagctcccatataccttcggaggtgggaccaaggtagaaatcaagcgaactgtcaggactgtcgctgccccgagcgttttcatcttccccccgtctgacgaacagcttaaaagcggcactgcaagcgtggtgtgcctgcttaacaatttctatcccagagaagcgaaggttcagtggaaggtggataacgccctgcaatctggcaatagccaggagtccgttacagaacaagattcaaaagactcaacgtactctctgtcctccacactgaccctgagcaaagctgattacgaaaaacataaggtttacgcctgcgaggtcacacaccaggggctttctagtccggtgactaaatcttttaaccgcggggaatgt

SEQ ID NO: 219 - DNA, 675 bp, Artificial Sequence
  Made in Lab - antibody fragment
gaggtgcagctggtcgagtcaggcggaggcctggttcagccagggagatccctcaggctttcctgcgccgcctccggttttaccttcaacgactacgctatgcactgggttcgccaggctcccggaaagggacttgaatgggtgagcactatcagctggaattctggaagcattgggtatgccgactccgtcaagggccgctttactatttctcgggataatgcgaagaagtctctgtacctgcagatgaacagtcttcgggcagaagacacggctctttactattgcgcaaaagacatccagtacggaaactattattacggaatggatgtgtggggtcagggcaccactgtgacagtaagcagtgctagtacaaagggaccttctgtgtttccacttgctcctagctccaaatccacgtccgggggcactgccgctctgggctgcctcgttaaagattacttcccagagcctgtcactgtgtcctggaattccggcgcccttacgtcaggggtacacacatttcccgcggtactccagtcaagcggcttgtacagcctgtcctccgtagtgacagtgccttcctcttctctcggcactcaaacttacatctgcaatgtcaatcacaaaccgagtaacactaaggttgacaagaaagttgaacctaagagctgt

SEQ ID NO: 220 - DNA, 642 bp, Artificial Sequence
  Made in Lab - antibody fragment
gaaatcgtcctgacgcagtcacctgcaaccctgagtctcagccctggtgagcgggccaccctgagctgcagggccagccagagtgtatcttcttacctggcttggtatcagcagaaaccaggacaggccccaagactgctgatctacgacgcttccaatagagccacgggcatccctgcccgattttccggatcagggtccggtacagatttcacgctgaccatcagctccctcgagcccgaagattttgctgtgtattattgccagcagcggtccaattggcccattaccttcggtcaggggaccaggctggagattaaacggaccgtggctgctccctcagttttcatctttcccccatctgatgagcagctgaagtccgggaccgcaagcgtcgtgtgcctccttaacaatttttacccacgagaagctaaggttcagtggaaggtggataatgctctccagtccggtaattctcaggaatcagtgaccgaacaggatagcaaagattctacctatagcttgtcatcaactctgaccctctccaaagccgactacgagaaacacaaagtctacgcatgcgaggtgactcaccaaggtctgagttcacccgttactaaaagctttaacagaggagaatgt

SEQ ID NO: 221 - DNA, 672 bp, Artificial Sequence
  Made in Lab - antibody fragment
gaagttcagctggttgaatctggtggtggtctggttcagccgggtggttctctgcgtctgtcttgcgctgcttctggtttcaccttctctaacttcgacatggcttgggttcgtcaggctccgggtaaaggtctggtttgggtttcttctatcaccaccggtggtggtgacacctactacgctgactctgttaaaggtcgtttcaccatctctcgtgacaacgctaaatctaccctgtacctgcagatggactctctgcgttctgaagacaccgctgtttactactgcgttcgtcacggttactacgacggttaccacctgttcgactactggggtcagggtaccctggttaccgtttcttctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgactgtgccctctagcagcttgggcacccagacctacatctgcaacgtgaatcacaagcccagcaacaccaaggtggacaagaaagttgagcccaaatcttgt

SEQ ID NO: 222 - DNA, 642 bp, Artificial Sequence
  Made in Lab - antibody fragment
gacatccagatgacccagtctccgtcttctctgtctgcttctgttggtgaccgtgttaccatcacctgccgtgctaaccagggtatctctaacaacctgaactggtaccagcagaaaccgggtaaagctccgaaaccgctgatctactacacctctaacctgcagtctggtgttccgtctcgtttctctggttctggttctggtaccgactacaccctgaccatctcttctctgcagccggaagacttcgctacctactactgccagcagttcacctctctgccgtacaccttcggtcagggtaccaaactggaaatcaaacgaactgtggctgcaccatctgtcttcatcttcccgccatctgatgagcagttgaaatctggaactgcctctgtcgtgtgcctgctgaataacttctatcccagagaggccaaagtacagtggaaggtggataacgccctccaatcgggtaactcccaggagagtgtcacagagcaggacagcaaagacagcacctacagcctcagcagcaccctgacgctgagcaaagcagactacgagaaacacaaagtctacgcctgcgaagtcacccatcagggcctgtcctcgcccgtcacaaagagcttcaacaggggagagtgt

SEQ ID NO: 223 - DNA, 633 bp, Artificial Sequence
  Made in Lab - antibody fragment
gagattgtcctgacccagtcccctgctattatgtctgcttcccccggcgaaagagtgaccatgacctgtagtgcctccagcggcgtcaactacatgcactggtatcagcagaagccagggacctctccccggagatggatctacgacacatcaaagctggccagcggagtgcctgcacggttctccggatctggcagtgggactgactatagcctgaccatcagcagcatggagccagaagatgccgctacctactattgccatcagaggggctcctacacatttggcgggggaactaagctggagatcaaacgcacagtggcagcccccagcgtcttcatttttcccccttccgatgaacagctgaagtccggcactgcttctgtggtctgtctgctgaacaatttctatcccagagaggccaaggtgcagtggaaagtggacaacgctctgcagtccggcaacagccaggagagtgtgaccgaacaggatagtaaggacagcacatattctctgtctagtaccctgacactgagtaaggcagattacgagaagcacaaagtgtatgcctgcgaagtcactcatcagggactgtcaagccccgtgaccaagagcttcaaccggggcgagtgt

SEQ ID NO: 224 - DNA, 669 bp, Artificial Sequence
  Made in Lab - antibody fragment
caggtgcagctggtccagccaggggcagaggtcgtcaagccaggagcatccgtcaaactgtcatgtaaaacaagcgggtatactttcaccagcaattggatgcactgggtgaagcaggcccccggacagggcctggagtggatcggggaaattgaccctagtgattcatacactaactacaaccagaacttccagggaaaggccaaactgaccgtggacaaaagcacctccacagcttatatggaggtgagcagcctgcggtccgacgatactgcagtctactattgcgccagaggctctaacccttactattacgctatggattactgggggcagggaacaagcgtgactgtctctagtgcatcaacaaagggaccaagcgtgtttccactggccccctcaagcaagagcacctccggagggacagccgctctgggatgtctggtgaaagactacttccccgagcctgtgactgtctcttggaatagtggcgctctgacctccggggtgcacacatttccagcagtcctgcagtcctctggactgtattctctgagttcagtggtcaccgtgcccagctcctctctgggcactcagacctacatctgcaatgtcaaccataagcctagtaacacaaaagtggataagaaagtcgaaccaaagagctgt

SEQ ID NO: 225 - DNA, 672 bp, Artificial Sequence
  Made in Lab - antibody fragment
caggtccaactgcaggagtcaggaggaggcttggtacagcctgggggttctctgagactctcctgtgcaacttctgggttcaccttcactgattactacatgaactgggtccgccagcctccaggaaaggcacttgagtggttgggttttattggaaacaaagctaatggttacacaacagagtacagtgcatctgtgaagggtcggttcaccatctccagagataaatcccaaagcatcctctatcttcaaatgaacaccctgagagctgaggacagtgccacttattactgtaccagagatagggggctacggttctactttgactactggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgactgtgccctctagcagcttgggcacccagacctacatctgcaacgtgaatcacaagcccagcaacaccaaggtggacaagaaagttgagcccaaatcttgt

SEQ ID NO: 226 - DNA, 642 bp, Artificial Sequence
  Made in Lab - antibody fragment
gacattgagctcacccagtctccagcaatcctgtctgcatctccaggggagaaggtcacaatgacttgcagggccagctcaagtgtaacttacattcactggtaccagcagaagccaggatcctcccccaaatcctggatttatgccacatccaacctggcttctggagtccctgctcgcttcagtggcagtgggtctgggacctcttactctctcacaatcagcagagtggaggctgaagatgctgccacttattactgccaacattggagtagtaaaccaccgacgttcggtggagggaccaagctcgagatcaaaaaacgaactgtggctgcaccatctgtcttcatcttcccgccatctgatgagcagttgaaatctggaactgcctctgtcgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgtcctcgcccgtcacaaagagcttcaacaggggagagtgt

SEQ ID NO: 227-232 - skipped (6 entries)

SEQ ID NO: 233 - DNA, 660 bp, Artificial Sequence
  Made in Lab - antibody fragment
gacatccagctgacccagtccccctcctccctgtccgcctccgtgggcgaccgggtgaccatgagctgcaagtcctcccagtccgtgctgtactccgccaaccacaagaactacctggcctggtaccagcagaagcccggcaaggcccccaagctgctgatctactgggccagcacccgcgagagcggcgtgccctcccggttctccggctccggctccggcaccgacttcaccttcaccatctcctccctgcagcccgaggacatcgccacctactactgccaccagtacctgtcctcctggaccttcggcggcggcaccaagctggagatcaagcgcacggtggccgcccccagtgtcttcattttccccccttccgatgagcagctgaagagcggtacagcctctgttgtttgtctgctgaacaacttctatccacgcgaggccaaggtgcagtggaaagttgataacgcgctgcagagtggcaactcccaggagtctgtgacagagcaggacagtaaagacagcacatattccctgtctagcacactgactctgtccaaggctgactatgagaagcacaaggtgtacgcttgcgaggtcacccaccagggactgagttctcctgtgaccaagtccttcaatcgcggcgagtgttaa

SEQ ID NO: 234 - DNA, 660 bp, Artificial Sequence
  Made in Lab - antibody fragment
caggtgcagctggtgcagtccggcgccgaggtgaagaagcccggctcctccgtgaaggtgtcctgcaaggcctccggctacaccttcacctcctactggctgcactgggtgcggcaggcccccggccagggcctggagtggatcggctacatcaacccccggaacgactacaccgagtacaaccagaacttcaaggacaaggccaccatcaccgccgacgagtccaccaacaccgcctacatggagctgtcctccctgcggtccgaggacaccgccttctacttctgcgcccggcgggacatcaccaccttctactggggccagggcaccactgtgaccgtgtcctccgccaggaccaaaggaccgtccgtctttcctctggccccttcctctaagtccacaagcggtgggaccgcagcactgggatgcctggtgaaggattacttccctgagccggtgaccgtgtcctggaactccggagctctcacctccggtgtccatacctttcctgccgtcctgcagtcctccggcctgtacagcctctctagcgtcgtgactgtgccctccagctccctgggcacccaaacttatatctgcaatgttaaccacaagccttctaataccaaggtcgacaagaaagtggagccgaagagctgttaa

SEQ ID NO: 235 - DNA, 1338 bp, Artificial Sequence
  Made in Lab - antibody fragment
caggtgcagctggtgcagtccggcgccgaggtgaagaagcccggctcctccgtgaaggtgtcctgcaaggcctccggctacaccttcacctcctactggctgcactgggtgcggcaggcccccggccagggcctggagtggatcggctacatcaacccccggaacgactacaccgagtacaaccagaacttcaaggacaaggccaccatcaccgccgacgagtccaccaacaccgcctacatggagctgtcctccctgcggtccgaggacaccgccttctacttctgcgcccggcgggacatcaccaccttctactggggccagggcaccactgtgaccgtgtcctccgccaggaccaaaggaccgtccgtctttcctctggccccttcctctaagtccacaagcggtgggaccgcagcactgggatgcctggtgaaggattacttccctgagccggtgaccgtgtcctggaactccggagctctcacctccggtgtccatacctttcctgccgtcctgcagtcctccggcctgtacagcctctctagcgtcgtgactgtgccctccagctccctgggcacccaaacttatatctgcaatgttaaccacaagccttctaataccaaggtcgacaagaaagtggagccgaagagctgtgacaaaactcacacatgcccaccgtgcccagcacctccagtcgccggaccgtcagtcttcctcttccctccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaaggcctcccaagctccatcgagaaaaccatctccaaagccaaagggcagccccgagaaccacaggtgtacaccctgcctccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataa

SEQ ID NO: 236 - DNA, 1362 bp, Artificial Sequence
  Made in Lab - antibody fragment
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaagtgactggggatctcgaggatgcttttgatatctggggccaagggacaatggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgactgtgccctctagcagcttgggcacccagacctacatctgcaacgtgaatcacaagcccagcaacaccaaggtggacaagaaagttgagcccaaatcttgtgacaaaactcacacatgcccaccgtgcccagcacctccagtcgccggaccgtcagtcttcctcttccctccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaaggcctcccaagctccatcgagaaaaccatctccaaagccaaagggcagccccgagaaccacaggtgtacaccctgcctccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataa

SEQ ID NO: 237 - protein, 218 aa, Artificial Sequence
  Made in Lab - antibody fragment
DIQLTQSPSTLSASVGDRVTITCRASESLDNYGIRFLTWFQQKPGKAPKLLMYAASNQGSGVPSRFSGSGSGTEFTLTISSLQPDDFATYYCQQTKEVPWSFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 238 - protein, 224 aa, Artificial Sequence
  Made in Lab - antibody fragment
EVQLVQSGAEVKKPGSSVKVSCKASGYTITDSNIHWVRQAPGQSLEWIGYIYPYNGGTDYNQKFKNRATLTVDNPTNTAYMELSSLRSEDTAFYYCVNGNPWLAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 239 - protein, 217 aa, Artificial Sequence
  Made in Lab - antibody fragment
DIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 240 - protein, 221 aa, Artificial Sequence
  Made in Lab - antibody fragment
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSARTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 241 - protein, 213 aa, Artificial Sequence
  Made in Lab - antibody fragment
DVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 242 - protein, 218 aa, Artificial Sequence
  Made in Lab - antibody fragment
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSARTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 243 - protein, 107 aa, Artificial Sequence; identical to SEQ ID NO: 197
  Made in Lab - antibody fragment

SEQ ID NO: 244 - protein, 222 aa, Artificial Sequence; identical to SEQ ID NO: 198
  Made in Lab - antibody fragment

SEQ ID NO: 245 - protein, 13 aa, Artificial Sequence
  Made in Lab - antibody fragment
NYHLENEVARLKK

SEQ ID NO: 246 - protein, 20 aa, Artificial Sequence
  Made in Lab - antibody fragment
METDTLLLWVLLLWVPGSTG

SEQ ID NO: 247 - protein, 107 aa, Artificial Sequence; identical to SEQ ID NO: 197
  Made in Lab - antibody fragment

SEQ ID NO: 248 - protein, 119 aa, Artificial Sequence
  Made in Lab - antibody fragment
EVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSS

SEQ ID NO: 249 - protein, 107 aa, Artificial Sequence
  Made in Lab - antibody fragment
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKLEIK

SEQ ID NO: 250 - protein, 114 aa, Artificial Sequence
  Made in Lab - antibody fragment
QLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSS

SEQ ID NO: 251 - protein, 107 aa, Artificial Sequence
  Made in Lab - antibody fragment
DIQMTQSPSSLSASVGDRVTITCRANQGISNNLNWYQQKPGKAPKPLIYYTSNLQSGVPSRFSGSGSGTDYTLTISSLQPEDFATYYCQQFTSLPYTFGQGTKLEIK

SEQ ID NO: 252 - protein, 121 aa, Artificial Sequence
  Made in Lab - antibody fragment
EVQLVESGGGLVQPGGSLRLSCAASGFTFSNFDMAWVRQAPGKGLVWVSSITTGGGDTYYADSVKGRFTISRDNAKSTLYLQMDSLRSEDTAVYYCVRHGYYDGYHLFDYWGQGTLVTVSS

SEQ ID NO: 253 - protein, 107 aa, Artificial Sequence; identical to SEQ ID NO: 25
  Made in Lab - antibody fragment

SEQ ID NO: 254 - protein, 120 aa, Artificial Sequence; identical to SEQ ID NO: 15
  Made in Lab - antibody fragment

SEQ ID NO: 255 - protein, 108 aa, Artificial Sequence
  Made in Lab - antibody fragment
ENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELK

SEQ ID NO: 256 - protein, 123 aa, Artificial Sequence
  Made in Lab - antibody fragment
DIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSS

SEQ ID NO: 257 - protein, 111 aa, Artificial Sequence [sequence omitted]

SEQ ID NO: 258 - protein, 116 aa, Artificial Sequence [sequence omitted]

SEQ ID NO: 259 - protein, 111 aa, Artificial Sequence
  Made in Lab - antibody fragment
DIQMTQSPSSLSASVGDRVTITCRASESVDNYGISFMNWFQQKPGKAPKLLIYAASNQGSGVPSRFSGSGSGTDFTLNISSLQPDDFATYYCQQSKEVPWTFGQGTKVEIK

SEQ ID NO: 260 - protein, 116 aa, Artificial Sequence
  Made in Lab - antibody fragment
QVQLVQSGAEVKKPGSSVKVSCKASGYTFTDYNMHWVRQAPGQGLEWIGYIYPYNGGTGYNQKFKSKATITADESTNTAYMELSSLRSEDTAVYYCARGRPAMDYWGQGTLVTVSS

SEQ ID NO: 261 - protein, 111 aa, Artificial Sequence
  Made in Lab - antibody fragment
DIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELK

SEQ ID NO: 262 - protein, 118 aa, Artificial Sequence
  Made in Lab - antibody fragment
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSS

SEQ ID NO: 263 - protein, 107 aa, Artificial Sequence
  Made in Lab - antibody fragment
DVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIK

SEQ ID NO: 264 - protein, 115 aa, Artificial Sequence
  Made in Lab - antibody fragment
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSS

SEQ ID NO: 265 - protein, 107 aa, Artificial Sequence
  Made in Lab - antibody fragment
DIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIK

SEQ ID NO: 266 - protein, 124 aa, Artificial Sequence
  Made in Lab - antibody fragment
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSS

SEQ ID NO: 267 - protein, 112 aa, Artificial Sequence [sequence omitted]

SEQ ID NO: 268 - protein, 116 aa, Artificial Sequence [sequence omitted]

SEQ ID NO: 269 - protein, 15 aa, Artificial Sequence
  Motif of GNC4 peptide derivatives
  MOD_RES (1)..(1): Any amino acid or absent
  MOD_RES (14)..(15): Any amino acid or absent
XNYHLENEVARLKXX

SEQ ID NO: 270 - protein, 475 aa, Artificial Sequence
  Made in Lab - CAR construct
MGVPTQLLGLLLLWITDAICDIQMTQSPASLSTSLGETVTIQCQASEDIYSGLAWYQQKPGKSPQLLIYGASDLQDGVPSRFSGSGSGTQYSLKITSMQTEDEGVYFCQQGLTYPRTFGGGTKLELKGGGGSGGGGSGGGGSEVQLQQSGAELVRPGTSVKLSCKVSGDTITFYYMHFVKQRPGQGLEWIGRIDPEDESTKYSEKFKNKATLTADTSSNTAYLKLSSLTSEDTATYFCIYGGYYFDYWGQGVMVTVSSIEFMYPPPYLDNERSNGTIIHIKEKHLCHTQSSPKLFWALVVVAGVLFCYGLLVTVALCVIWTNSRRNRGGQSDYMNMTPRRPGLTRKPYQPYAPARDFAAYRPRAKFSRSAETAANLQDPNQLFNELNLGRREEFDVLEKKRARDPEMGGKQQRRRNPQEGVYNALQKDKMAEAYSEIGTKGERRRGKGHDGLFQGLSTATKDTFDALHMQTLAPR

SEQ ID NO: 271 - protein, 460 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSIEFMYPPPYLDNERSNGTIIHIKEKHLCHTQSSPKLFWALVVVAGVLFCYGLLVTVALCVIWTNSRRNRGGQSDYMNMTPRRPGLTRKPYQPYAPARDFAAYRPRAKFSRSAETAANLQDPNQLFNELNLGRREEFDVLEKKRARDPEMGGKQQRRRNPQEGVYNALQKDKMAEAYSEIGTKGERRRGKGHDGLFQGLSTATKDTFDALHMQTLAPR

SEQ ID NO: 272 - protein, 436 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPFWALVVVAGVLFCYGLLVTVALCVIWTNSRRNRGGQSDYMNMTPRRPGLTRKPYQPYAPARDFAAYRPRAKFSRSAETAANLQDPNQLFNELNLGRREEFDVLEKKRARDPEMGGKQQRRRNPQEGVYNALQKDKMAEAYSEIGTKGERRRGKGHDGLFQGLSTATKDTFDALHMQTLAPR

SEQ ID NO: 273 - protein, 440 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPFWALVVVAGVLFCYGLLVTVALCVIWTKWIRKKFPHIFKQPFKKTTGAAQEEDACSCRCPQEEEGGGGGYELRAKFSRSAETAANLQDPNQLFNELNLGRREEFDVLEKKRARDPEMGGKQQRRRNPQEGVYNALQKDKMAEAYSEIGTKGERRRGKGHDGLFQGLSTATKDTFDALHMQTLAPR

SEQ ID NO: 274 - protein, 481 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPFWALVVVAGVLFCYGLLVTVALCVIWTNSRRNRGGQSDYMNMTPRRPGLTRKPYQPYAPARDFAAYRPKWIRKKFPHIFKQPFKKTTGAAQEEDACSCRCPQEEEGGGGGYELRAKFSRSAETAANLQDPNQLFNELNLGRREEFDVLEKKRARDPEMGGKQQRRRNPQEGVYNALQKDKMAEAYSEIGTKGERRRGKGHDGLFQGLSTATKDTFDALHMQTLAPR

SEQ ID NO: 275 - protein, 436 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPFWALVVVAGVLFCYGLLVTVALCVIWTNSRRNRGGQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 276 - protein, 440 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPFWALVVVAGVLFCYGLLVTVALCVIWTKWIRKKFPHIFKQPFKKTTGAAQEEDACSCRCPQEEEGGGGGYELRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 277 - protein, 481 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPFWALVVVAGVLFCYGLLVTVALCVIWTNSRRNRGGQSDYMNMTPRRPGLTRKPYQPYAPARDFAAYRPKWIRKKFPHIFKQPFKKTTGAAQEEDACSCRCPQEEEGGGGGYELRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 278 - protein, 464 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSTTTKPVLRTPSPVHPTGTSQPQRPEDCRPRGSVKGTGLDFACDIYIWAPLAGICVALLLSLIITLICNSRRNRGGQSDYMNMTPRRPGLTRKPYQPYAPARDFAAYRPRAKFSRSAETAANLQDPNQLFNELNLGRREEFDVLEKKRARDPEMGGKQQRRRNPQEGVYNALQKDKMAEAYSEIGTKGERRRGKGHDGLFQGLSTATKDTFDALHMQTLAPR

SEQ ID NO: 279 - protein, 468 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSTTTKPVLRTPSPVHPTGTSQPQRPEDCRPRGSVKGTGLDFACDIYIWAPLAGICVALLLSLIITLICKWIRKKFPHIFKQPFKKTTGAAQEEDACSCRCPQEEEGGGGGYELRAKFSRSAETAANLQDPNQLFNELNLGRREEFDVLEKKRARDPEMGGKQQRRRNPQEGVYNALQKDKMAEAYSEIGTKGERRRGKGHDGLFQGLSTATKDTFDALHMQTLAPR

SEQ ID NO: 280 - protein, 509 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSTTTKPVLRTPSPVHPTGTSQPQRPEDCRPRGSVKGTGLDFACDIYIWAPLAGICVALLLSLIITLICNSRRNRGGQSDYMNMTPRRPGLTRKPYQPYAPARDFAAYRPKWIRKKFPHIFKQPFKKTTGAAQEEDACSCRCPQEEEGGGGGYELRAKFSRSAETAANLQDPNQLFNELNLGRREEFDVLEKKRARDPEMGGKQQRRRNPQEGVYNALQKDKMAEAYSEIGTKGERRRGKGHDGLFQGLSTATKDTFDALHMQTLAPR

SEQ ID NO: 281 - protein, 464 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSTTTKPVLRTPSPVHPTGTSQPQRPEDCRPRGSVKGTGLDFACDIYIWAPLAGICVALLLSLIITLICNSRRNRGGQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 282 - protein, 468 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSTTTKPVLRTPSPVHPTGTSQPQRPEDCRPRGSVKGTGLDFACDIYIWAPLAGICVALLLSLIITLICKWIRKKFPHIFKQPFKKTTGAAQEEDACSCRCPQEEEGGGGGYELRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 283 - protein, 509 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSTTTKPVLRTPSPVHPTGTSQPQRPEDCRPRGSVKGTGLDFACDIYIWAPLAGICVALLLSLIITLICNSRRNRGGQSDYMNMTPRRPGLTRKPYQPYAPARDFAAYRPKWIRKKFPHIFKQPFKKTTGAAQEEDACSCRCPQEEEGGGGGYELRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 284 - protein, 433 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPIYIWAPLAGICVALLLSLIITLICNSRRNRGGQSDYMNMTPRRPGLTRKPYQPYAPARDFAAYRPRAKFSRSAETAANLQDPNQLFNELNLGRREEFDVLEKKRARDPEMGGKQQRRRNPQEGVYNALQKDKMAEAYSEIGTKGERRRGKGHDGLFQGLSTATKDTFDALHMQTLAPR

SEQ ID NO: 285 - protein, 437 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPIYIWAPLAGICVALLLSLIITLICKWIRKKFPHIFKQPFKKTTGAAQEEDACSCRCPQEEEGGGGGYELRAKFSRSAETAANLQDPNQLFNELNLGRREEFDVLEKKRARDPEMGGKQQRRRNPQEGVYNALQKDKMAEAYSEIGTKGERRRGKGHDGLFQGLSTATKDTFDALHMQTLAPR

SEQ ID NO: 286 - protein, 478 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPIYIWAPLAGICVALLLSLIITLICNSRRNRGGQSDYMNMTPRRPGLTRKPYQPYAPARDFAAYRPKWIRKKFPHIFKQPFKKTTGAAQEEDACSCRCPQEEEGGGGGYELRAKFSRSAETAANLQDPNQLFNELNLGRREEFDVLEKKRARDPEMGGKQQRRRNPQEGVYNALQKDKMAEAYSEIGTKGERRRGKGHDGLFQGLSTATKDTFDALHMQTLAPR

SEQ ID NO: 287 - protein, 433 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPIYIWAPLAGICVALLLSLIITLICNSRRNRGGQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 288 - protein, 437 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPIYIWAPLAGICVALLLSLIITLICKWIRKKFPHIFKQPFKKTTGAAQEEDACSCRCPQEEEGGGGGYELRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 289 - protein, 478 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPIYIWAPLAGICVALLLSLIITLICNSRRNRGGQSDYMNMTPRRPGLTRKPYQPYAPARDFAAYRPKWIRKKFPHIFKQPFKKTTGAAQEEDACSCRCPQEEEGGGGGYELRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 290 - protein, 243 aa, Artificial Sequence
  Made in Lab - Humanized scFv fragments
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSS

SEQ ID NO: 291 - protein, 243 aa, Artificial Sequence
  Made in Lab - Humanized scFv fragments
QAVVTQEPSLTVSPGGTVTLTCRSSTGAVTTSNYASWFQQKPGQAPRTLIYGTNNRAPWTPARFSGSLLGGKAALTLSGAQPEDEAEYYCVLWYSDHWVFGGGTKLTVLGGGGGSGGGGSGGGGSGGGGSQVQLQESGPGLVKPSETLSLTCTVSGFLLTDYGVNWIRQPPGKGLEWIGVIWGDGITDYNPSLKSRVTISVDTSKNQFSLKLSSVTAADTAVYYCARGLFDYWGQGTLVTVSS

SEQ ID NO: 292 - protein, 243 aa, Artificial Sequence
  Made in Lab - Humanized scFv fragments
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSLTCTVSGFLLTDYGVNWIRQPPGKGLEWIGVIWGDGITDYNPSLKSRVTISKDTSKNQFSLKLSSVTAADTAVYYCVTGLFDYWGQGTLVTVSS

SEQ ID NO: 293 - protein, 243 aa, Artificial Sequence
  Made in Lab - Humanized scFv fragments
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSLTCTVSGFLLTDYGVNWIRQPPGKGLEWIGVIWGDGITDYNPSLKSRVTISKDNSKNQFSLKLSSVTAADTAVYYCVTGLFDYWGQGTLVTVSS

SEQ ID NO: 294 - protein, 243 aa, Artificial Sequence
  Made in Lab - Humanized scFv fragments
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTAVYYCVTGLFDYWGQGTLLTVSS

SEQ ID NO: 295 - protein, 243 aa, Artificial Sequence
  Made in Lab - Humanized scFv fragments
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDNSKNQVSLKMSSLTAADTAVYYCVTGLFDYWGQGTLLTVSS

SEQ ID NO: 296 - protein, 243 aa, Artificial Sequence
  Made in Lab - Humanized scFv fragments
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 297 - protein, 243 aa, Artificial Sequence
  Made in Lab - Humanized scFv fragments
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 298 - protein, 243 aa, Artificial Sequence
  Made in Lab - Humanized scFv fragments
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDNSKNQVSLKMSSLTAADTAVYYCVTGLFDYWGQGTLLTVSS

SEQ ID NO: 299 - protein, 243 aa, Artificial Sequence
  Made in Lab - Humanized scFv fragments
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQQSGPGLVKPSETLSITCTVSGFSLTDYGVNWVRQPPGKGLEWLGVIWGDGSTDYNPSLKSRLTVSKDNSKNQVSLKMSSLTAADTAVYYCVTGLFDYWGQGTLLTVSS

SEQ ID NO: 300 - protein, 243 aa, Artificial Sequence
  Made in Lab - Humanized scFv fragments
QAVVTQEPSLTVSPGGTVTLTCRSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDNSKNQVSLKMSSLTAADTAVYYCVTGLFDYWGQGTLLTVSS

SEQ ID NO: 301 - protein, 243 aa, Artificial Sequence
  Made in Lab - Humanized scFv fragments
QAVVTQEPSLTVSPGGTVTLTCRSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDNSKNQVSLKMSSLTAADTAVYYCVTGLFDYWGQGTLLTVSS

SEQ ID NO: 302 - protein, 243 aa, Artificial Sequence
  Made in Lab - Humanized scFv fragments
QAVVTQEPSLTVSPGGTVTLTCRSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQQSGPGLVKPSETLSITCTVSGFSLTDYGVNWVRQPPGKGLEWLGVIWGDGSTDYNPSLKSRLTVSKDNSKNQVSLKMSSLTAADTAVYYCVTGLFDYWGQGTLLTVSS

SEQ ID NO: 303 - protein, 243 aa, Artificial Sequence
  Made in Lab - Humanized scFv fragments
QAVVTQEPSLTVSPGGTVTLTCGSSTGAVTTSNYASWVQQKPGQAFRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSLTCTVSGFLLTDYGVNWIRQPPGKGLEWIGVIWGDGITDYNPSLKSRVTISKDTSKNQFSLKLSSVTAADTAVYYCVTGLFDYWGQGTLVTVSS

SEQ ID NO: 304 - protein, 243 aa, Artificial Sequence
  Made in Lab - Humanized scFv fragments
QAVVTQEPSLTVSPGGTVTLTCGSSTGAVTTSNYASWVQQKPGQAFRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTAVYYCVTGLFDYWGQGTLLTVSS

SEQ ID NO: 305 - protein, 243 aa, Artificial Sequence
  Made in Lab - Humanized scFv fragments
QAVVTQEPSLTVSPGGTVTLTCGSSTGAVTTSNYASWVQQKPGQAFRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 306 - protein, 243 aa, Artificial Sequence
  Made in Lab - Humanized scFv fragments
QAVVTQEPSLTVSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSLTCTVSGFLLTDYGVNWIRQPPGKGLEWIGVIWGDGITDYNPSLKSRVTISKDTSKNQFSLKLSSVTAADTAVYYCVTGLFDYWGQGTLVTVSS

SEQ ID NO: 307 - protein, 243 aa, Artificial Sequence
  Made in Lab - Humanized scFv fragments
QAVVTQEPSLTVSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTAVYYCVTGLFDYWGQGTLLTVSS

SEQ ID NO: 308 - protein, 243 aa, Artificial Sequence
  Made in Lab - Humanized scFv fragments
QAVVTQEPSLTVSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 309 - protein, 243 aa, Artificial Sequence
  Made in Lab - Humanized scFv fragments
QAVVTQEPSLTVSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 310 - protein, 243 aa, Artificial Sequence
  Made in Lab - Humanized scFv fragments
QAVVTQEPSLTVSPGGTVTLTCGSSTGAVTTSNYASWVQQKPDHLFRGLIGGTNNRAPGVPARFSGSLIGDKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 311 - protein, 243 aa, Artificial Sequence
  Made in Lab - Humanized scFv fragments
QAVVTQEPSLTVSPGGTVTLTCRSSTGAVTTSNYASWVQQKPDHLFRGLIGGTNNRAPGVPARFSGSLIGDKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 312 - protein, 243 aa, Artificial Sequence
  Made in Lab - Humanized scFv fragments
QAVVTQEPSLTVSPGGTVTLTCRSSTGAVTTSNYASWVQQKPDHLFRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 313 - protein, 243 aa, Artificial Sequence
  Made in Lab - Humanized scFv fragments
QAVVTQEPSLTVSPGGTVTLTCRSSTGAVTTSNYASWVQQKPDHLFRGLIGGTNNRAPGVPARFSGSLLGGKAALTISGAQPEDEAEYYCVLWYSDHWVFGGGTKLTVLGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 314 - protein, 243 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 315 - protein, 243 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 316 - protein, 243 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 317 - protein, 243 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 318 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 319 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 320 - protein, 243 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 321 - protein, 243 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 322 - protein, 243 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 323 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 324 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 325 - protein, 243 aa, Artificial Sequence
  Made in Lab - Humanized scFv fragments
QAVVTQEPSLTSSPGGTVTLTCGSSTGAVTTSNYASWVQQKPDHLFRGLIGGTNNRAPGVPARFSGSLLGGKAALTISGAQPEDEAIYFCVLWYSDHWVFGGGTKLTVDGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 326 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAEYFCVLWYSDHWVFGGGTKLTVDGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 327 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAIYYCVLWYSDHWVFGGGTKLTVDGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 328 - protein, 243 aa, Artificial Sequence
  Made in Lab - Humanized scFv fragments
QAVVTQEPSLTSSPGGTVTLTCGSSTGAVTTSNYASWVQQKPDHLFRGLIGGTNNRAPGVPARFSGSLLGGKAALTISGAQPEDEAEYFCVLWYSDHWVFGGGTKLTVDGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 329 - protein, 243 aa, Artificial Sequence
  Made in Lab - Humanized scFv fragments
QAVVTQEPSLTSSPGGTVTLTCGSSTGAVTTSNYASWVQQKPDHLFRGLIGGTNNRAPGVPARFSGSLLGGKAALTISGAQPEDEAIYYCVLWYSDHWVFGGGTKLTVDGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 330 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAEYYCVLWYSDHWVFGGGTKLTVDGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 331 - protein, 243 aa, Artificial Sequence
  Made in Lab - Humanized scFv fragments
QAVVTQEPSLTSSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVDGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 332 - protein, 243 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSS

SEQ ID NO: 333 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSS

SEQ ID NO: 334 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLDGGKAALTISGAQPEDEAIYFCVLWYSDHWVFGGGTKLTVSGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 335 - protein, 243 aa, Artificial Sequence
  Made in Lab - Humanized scFv fragments
QAVVTQEPSLTSSPGGTVTLTCRSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 336 - protein, 243 aa, Artificial Sequence
  Made in Lab - Humanized scFv fragments
QAVVTQEPSLTSSPGGTVTLTCRSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 337 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLDGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 338 - protein, 242 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 339 - protein, 242 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 340 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLDGGKAALTISGAQPEDEAIYFCVLWYSDHWVFGGGTKLTVSGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSS

SEQ ID NO: 341 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSS

SEQ ID NO: 342 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 343 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLDGGKAALTISGAQPEDEAIYFCVLWYSDHWVFGGGTKLTVSGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTSADTARYYCVTGLFDYWGQGTTLTVSS

SEQ ID NO: 344 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVSGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 345 - protein, 243 aa, Artificial Sequence; identical to SEQ ID NO: 318
  Made in Lab - Humanized scFv fragments

SEQ ID NO: 346 - protein, 243 aa, Artificial Sequence
  Made in Lab - Humanized scFv fragments
QAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTSADTARYYCVTGLFDYWGQGTTLTVSS

SEQ ID NO: 347 - protein, 243 aa, Artificial Sequence
  Made in Lab - Humanized scFv fragments
QAVVTQEPSLTVSPGGTVTLTCRSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 348 - protein, 243 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQQSGPGLVKPSETLSITCTVSGFSLTDYGVNWVRQPPGKGLEWLGVIWGDGSTDYNPSLKSRLTVSKDNSKNQVSLKMSSLTAADTAVYYCVTGLFDYWGQGTLLTVSS

SEQ ID NO: 349 - protein, 243 aa, Artificial Sequence
  Made in Lab - Humanized scFv fragments
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQQSGPGLVKPSETLSITCTVSGFSLTDYGVNWVRQPPGKGLEWLGVIWGDGSTDYNPSLKSRLTVSKDTSKNQVSLKMSSLTAADTAVYYCVTGLFDYWGQGTLLTVSS

SEQ ID NO: 350 - protein, 243 aa, Artificial Sequence
  Made in Lab - Humanized scFv fragments
QAVVTQEPSLTVSPGGTVTLTCGSSTGAVTTSNYASWVQEKPGQAFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 351 - protein, 243 aa, Artificial Sequence
  Made in Lab - Humanized scFv fragments
QAVVTQEPSLTVSPGGTVTLTCGSSTGAVTTSNYASWVQEKPGQAFRGLIGGTNNRAPGVPARFSGSLLGGKAALTISGAQPEDEAIYFCVLWYSDHWVFGGGTKLTVLGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 352 - protein, 243 aa, Artificial Sequence
  Made in Lab - Humanized scFv fragments
QAVVTQEPSLTVSPGGTVTLTCGSSTGAVTTSNYASWVQEKPGQAPRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 353 - protein, 243 aa, Artificial Sequence
  Made in Lab - Humanized scFv fragments
QAVVTQEPSLTVSPGGTVTLTCGSSTGAVTTSNYASWVQEKPGQAFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 354 - protein, 243 aa, Artificial Sequence
  Made in Lab - Humanized scFv fragments
QAVVTQEPSLTVSPGGTVTLTCGSSTGAVTTSNYASWVQEKPGQAPRGLIGGTNNRAPGVPARFSGSLLGGKAALTISGAQPEDEAIYFCVLWYSDHWVFGGGTKLTVLGGGGGSGGGGSGGGGSGGGGSQVQLQQSGPGLVKPSETLSITCTVSGFSLTDYGVNWVRQPPGKGLEWLGVIWGDGSTDYNPSLKSRLTVSKDNSKNQVSLKMSSLTAADTAVYYCVTGLFDYWGQGTLLTVSS

SEQ ID NO: 355 - protein, 243 aa, Artificial Sequence
  Made in Lab - Humanized scFv fragments
DAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGGGGGSGGGGSGGGGSGGGGSDVQLQESGPGLVAPSQSLSITCTVSGFSLTDYGVNWVRQSPGKGLEWLGVIWGDGITDYNSALKSRLSVTKDNSKSQVFLKMNSLQSGDSARYYCVTGLFDYWGQGTTLTVSS

SEQ ID NO: 356 - protein, 243 aa, Artificial Sequence
  Made in Lab - Humanized scFv fragments
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 357 - protein, 243 aa, Artificial Sequence
  Made in Lab - Humanized scFv fragments
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSS

SEQ ID NO: 358 - protein, 243 aa, Artificial Sequence
  Made in Lab - Humanized scFv fragments
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTSADTARYYCVTGLFDYWGQGTTLTVSS

SEQ ID NO: 359 - protein, 243 aa, Artificial Sequence
  Made in Lab - Humanized scFv fragments
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 360 - protein, 243 aa, Artificial Sequence
  Made in Lab - Humanized scFv fragments
QVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSSGGGGSGGGGSGGGGSGGGGSQAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLG

SEQ ID NO: 361 - protein, 243 aa, Artificial Sequence
  Made in Lab - Humanized scFv fragments
QVQLQQSGPGLVKPSETLSITCTVSGFLLTDYGVNWVRQPPGKGLEWLGVIWGDGITDYNPSLKSRLTVSKDTSKNQVSLKMSSLTSADTARYYCVTGLFDYWGQGTTLTVSSGGGGSGGGGSGGGGSGGGGSQAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLG

SEQ ID NO: 362 - protein, 243 aa, Artificial Sequence
  Made in Lab - Humanized scFv fragments
QVQLQQSGPGLVKPSETLSITCTVSGFLLTDYGVNWVRQPPGKGLEWLGVIWGDGITDYNPSLKSRLTVSKDTSKNQVSLKMSSLTSADTARYYCVTGLFDYWGQGTTLTVSSGGGGSGGGGSGGGGSGGGGSQAVVTQEPSLTVSPGGTVTLTCRSSTGAVTTSNYASWVQEKPDHLFRGLIGGTNNRAPGVPARFSGSLLGGKAALTISGAQPEDEAIYFCVLWYSDHWVFGGGTKLTVLG

SEQ ID NO: 363 - protein, 243 aa, Artificial Sequence
  Made in Lab - Humanized scFv fragments
QVQLQQSGPGLVKPSETLSITCTVSGFSLTDYGVNWVRQPPGKGLEWLGVIWGDGSTDYNPSLKSRLTVSKDNSKNQVSLKMSSLTAADTAVYYCVTGLFDYWGQGTLLTVSSGGGGSGGGGSGGGGSGGGGSQAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLG

SEQ ID NO: 364 - protein, 243 aa, Artificial Sequence
  Made in Lab - Humanized scFv fragments
QVQLQESGPGLVKPSETLSITCTVSGFLLTDYGVNWVRQPPGKGLEWLGVIWGDGITDYNPSLKSRLTVSKDNSKNQVSLKMSSLTAADTAVYYCVTGLFDYWGQGTLLTVSSGGGGSGGGGSGGGGSGGGGSQAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLG

SEQ ID NO: 365 - protein, 243 aa, Artificial Sequence
  Made in Lab - Humanized scFv fragments
QVQLQQSGPGLVKPSETLSITCTVSGFLLTDYGVNWVRQPPGKGLEWLGVIWGDGITDYNPSLKSRLTVSKDNSKNQVSLKMSSLTAADTAVYYCVTGLFDYWGQGTLLTVSSGGGGSGGGGSGGGGSGGGGSQAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLG

SEQ ID NO: 366 - protein, 243 aa, Artificial Sequence
  Made in Lab - Humanized scFv fragments
QVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSSGGGGSGGGGSGGGGSGGGGSQAVVTQEPSLTVSPGGTVTLTCRSSTGAVTTSNYASWVQEKPDHLFRGLIGGTNNRAPGVPARFSGSLLGGKAALTISGAQPEDEAIYFCVLWYSDHWVFGGGTKLTVLG

SEQ ID NO: 367 - protein, 243 aa, Artificial Sequence
  Made in Lab - Humanized scFv fragments
QVQLQQSGPGLVKPSETLSITCTVSGFSLTDYGVNWVRQPPGKGLEWLGVIWGDGSTDYNPSLKSRLTVSKDNSKNQVSLKMSSLTAADTAVYYCVTGLFDYWGQGTLLTVSSGGGGSGGGGSGGGGSGGGGSQAVVTQEPSLTVSPGGTVTLTCRSSTGAVTTSNYASWVQQKPGQAPRGLIGGTNNRAPGVPARFSGSLLGGKAALTISGAQPEDEAEYYCVLWYSDHWVFGGGTKLTVLG

SEQ ID NO: 368 - protein, 243 aa, Artificial Sequence
  Made in Lab - Humanized scFv fragments
QVQLQESGPGLVKPSETLSITCTVSGFLLTDYGVNWVRQPPGKGLEWLGVIWGDGITDYNPSLKSRLTVSKDNSKNQVSLKMSSLTAADTAVYYCVTGLFDYWGQGTLLTVSSGGGGGSGGGGSGGGGSGGGGSQAVVTQEPSLTVSPGGTVTLTCRSSTGAVTTSNYASWVQQKPGQAPRGLIGGTNNRAPGVPARFSGSLLGGKAALTISGAQPEDEAEYYCVLWYSDHWVFGGGTKLTVL

SEQ ID NO: 369 - protein, 243 aa, Artificial Sequence
  Made in Lab - Humanized scFv fragments
QVQLQQSGPGLVKPSETLSITCTVSGFLLTDYGVNWVRQPPGKGLEWLGVIWGDGITDYNPSLKSRLTVSKDNSKNQVSLKMSSLTAADTAVYYCVTGLFDYWGQGTLLTVSSGGGGGSGGGGSGGGGSGGGGSQAVVTQEPSLTVSPGGTVTLTCRSSTGAVTTSNYASWVQQKPGQAPRGLIGGTNNRAPGVPARFSGSLLGGKAALTISGAQPEDEAEYYCVLWYSDHWVFGGGTKLTVL

SEQ ID NO: 370 - protein, 243 aa, Artificial Sequence
  Made in Lab - Humanized scFv fragments
QVQLQESGPGLVKPSETLSITCTVSGFLLTDYGVNWVRQPPGKGLEWLGVIWGDGITDYNPSLKSRLTVSKDTSKNQVSLKMSSLTSADTARYYCVTGLFDYWGQGTTLTVSSGGGGSGGGGSGGGGSGGGGSQAVVTQEPSLTSSPGGTVTLTCGSSTGAVTTSNYASWVQEKPDHLFRGLIGGTNNRAPGVPARFSGSLDGGKAALTISGAQPEDEAIYFCVLWYSDHWVFGGGTKLTVSG

SEQ ID NO: 371 - protein, 243 aa, Artificial Sequence
  Made in Lab - Humanized scFv fragments
QVQLQQSGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSSGGGGSGGGGSGGGGSGGGGSQAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLG

SEQ ID NO: 372 - protein, 243 aa, Artificial Sequence
  Made in Lab - Humanized scFv fragments
QVQLQQSGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSSGGGGSGGGGSGGGGSGGGGSQAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDG

SEQ ID NO: 373 - protein, 243 aa, Artificial Sequence
  Made in Lab - Humanized scFv fragments
DVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSGGGGSGGGGSGGGGSGGGGSDAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLG

SEQ ID NO: 374 - protein, 243 aa, Artificial Sequence
  Made in Lab - Humanized scFv fragments
QVQLQQSGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSSGGGGSGGGGSGGGGSGGGGSDAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLG

SEQ ID NO: 375 - protein, 243 aa, Artificial Sequence
  Made in Lab - Humanized scFv fragments
DVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSGGGGSGGGGSGGGGSGGGGSQAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLG

SEQ ID NO: 376 - protein, 245 aa, Artificial Sequence
  Made in Lab - Humanized scFv fragments
DIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGGSGGGGSGGGGSGGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSS

SEQ ID NO: 377 - protein, 245 aa, Artificial Sequence
  Made in Lab - Humanized scFv fragments
DIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGGSGGGGSGGGGSGGGGSEVKLLESGGGLVQPGGSLKLSCAVSGFSLTDYGVNWVRQAPGRGLEWIGVIWGDGITDYNSALKDRFIISKDDCENTVYLQMSKVRSDDTALYYCVTGLFDYWGQGTLVTVSS

SEQ ID NO: 378 - protein, 245 aa, Artificial Sequence
  Made in Lab - Humanized scFv fragments
DIVMTQSPSSLSASVGDRVTITCRSSTGAVTTSNYASWVQEKPGKLFKGLIGGTNNRAPGVPSRFSGSLIGDKATLTISSLQPEDFATYYCALWYSNHWVFGQGTKVELKRGGGGGSGGGGSGGGGSGGGGSEVKLLESGGGLVQPGGSLKLSCAVSGFSLTDYGVNWVRQAPGRGLEWIGVIWGDGTTDYNSALKDRFIISKDDCENTVYLQMSKVRSDDTALYYCVTGLFDYWGQGTLVTVSS

SEQ ID NO: 379 - protein, 245 aa, Artificial Sequence
  Made in Lab - Humanized scFv fragments
DIVMTQSPSSLSASVGDRVTITCRSSTGAVTTSNYASWVQEKPGKLFKGLIGGTNNRAPGVPSRFSGSLIGDKATLTISSLQPEDFATYYCALWYSNHWVFGQGTKVELKRGGGGGSGGGGSGGGGSGGGGSEVKLLESGGGLVQPGGSLKLSCAVSGFSLTDYGVNWVRQAPGRGLEWIGVIWGDGTTDYNSALKDRFIISKDDSENTVYLQMSKVRSDDTALYYCVTGLFDYWGQGTLVTVSS

SEQ ID NO: 380 - protein, 243 aa, Artificial Sequence
  Made in Lab - Humanized scFv fragments
DIQMTQSPSSLSASVGDRVTITCRSSTGAVTTSNYASWVQQKPGKAFKGLIGGTNNRAPGVPSRFSGSGSGTDATLTISSLQPEDFATYYCALWYSNHWVFGQGTKVELKGGGGSGGGGSGGGGSSGGGSEVQLVESGGGLVQPGGSLRLSCAVSGFSLTDYGVNWVRQAPGKGLEWIGVIWGDGTTDYADSLKGRFTISKDDSKNTVYLQMNSVRAEDTAVYYCVTGLFDYWGQGTLVTVSS

SEQ ID NO: 381 - protein, 243 aa, Artificial Sequence
  Made in Lab - Humanized scFv fragments
DIQMTQSPSSLSASVGDRVTITCRSSTGAVTTSNYASWVQQKPGKAFKGLIGGTNNRAPGVPSRFSGSLIGDKATLTISSLQPEDFATYYCALWYSNHWVFGQGTKVELKGGGGSGGGGSGGGGSSGGGSEVQLVESGGGLVQPGGSLRLSCAVSGFSLTDYGVNWVRQAPGKGLEWIGVIWGDGTTDYADSLKGRFTISKDDSKNTVYLQMNSVRAEDTAVYYCVTGLFDYWGQGTLVTVSS

SEQ ID NO: 382 - protein, 243 aa, Artificial Sequence
  Made in Lab - Humanized scFv fragments
DIQMTQSPSSLSASVGDRVTITCRSSTGAVTTSNYASWVQQKPGKAFKGLIGGTNNRAPGVPSRFSGSLLGGKATLTISSLQPEDFATYYCALWYSNHWVFGQGTKVELKGGGGSGGGGSGGGGSSGGGSEVQLVESGGGLVQPGGSLRLSCAVSGFSLTDYGVNWVRQAPGKGLEWIGVIWGDGTTDYADSLKGRFTISKDDSKNTVYLQMNSVRAEDTAVYYCVTGLFDYWGQGTLVTVSS

SEQ ID NO: 383 - protein, 243 aa, Artificial Sequence
  Made in Lab - Humanized scFv fragments
DIQMTQSPSSLSASVGDRVTITCRSSTGAVTTSNYASWVQQKPGKAFKGLIGGTNNRAPGVPSRFSGSLSGGKATLTISSLQPEDFATYYCALWYSNHWVFGQGTKVELKGGGGSGGGGSGGGGSSGGGSEVQLVESGGGLVQPGGSLRLSCAVSGFSLTDYGVNWVRQAPGKGLEWIGVIWGDGTTDYADSLKGRFTISKDDSKNTVYLQMNSVRAEDTAVYYCVTGLFDYWGQGTLVTVSS

SEQ ID NO: 384 - protein, 243 aa, Artificial Sequence
  Made in Lab - Humanized scFv fragments
DIQMTQSPSSLSASVGDRVTITCRSSTGAVTTSNYASWVQQKPGKAFKGLIGGTNNRAPGVPSRFSGSGSGTDATLTISSLQPEDFATYYCALWYSNHWVFGQGTKVELKGGGGSGGGGSGGGGSSGGGSEVQLVESGGGLVQPGGSLRLSCAVSGFSLTDYGVNWVRQAPGKGLEWLGVIWGDGTTDYADSLKGRFTISKDNSKNTVYLQMNSLRAEDTAVYYCVTGLFDYWGQGTLLTVSS

SEQ ID NO: 385 - protein, 243 aa, Artificial Sequence
  Made in Lab - Humanized scFv fragments
DIQMTQSPSSLSASVGDRVTITCRSSTGAVTTSNYASWVQQKPGKAFKGLIGGTNNRAPGVPSRFSGSLIGDKATLTISSLQPEDFATYYCALWYSNHWVFGQGTKVELKGGGGSGGGGSGGGGSSGGGSEVQLVESGGGLVQPGGSLRLSCAVSGFSLTDYGVNWVRQAPGKGLEWLGVIWGDGTTDYADSLKGRFTISKDNSKNTVYLQMNSLRAEDTAVYYCVTGLFDYWGQGTLLTVSS

SEQ ID NO: 386 - protein, 243 aa, Artificial Sequence
  Made in Lab - Humanized scFv fragments
DIQMTQSPSSLSASVGDRVTITCRSSTGAVTTSNYASWVQQKPGKAFKGLIGGTNNRAPGVPSRFSGSLLGGKATLTISSLQPEDFATYYCALWYSNHWVFGQGTKVELKGGGGSGGGGSGGGGSSGGGSEVQLVESGGGLVQPGGSLRLSCAVSGFSLTDYGVNWVRQAPGKGLEWLGVIWGDGTTDYADSLKGRFTISKDNSKNTVYLQMNSLRAEDTAVYYCVTGLFDYWGQGTLLTVSS

SEQ ID NO: 387 - protein, 243 aa, Artificial Sequence
  Made in Lab - Humanized scFv fragments
DIQMTQSPSSLSASVGDRVTITCRSSTGAVTTSNYASWVQQKPGKAFKGLIGGTNNRAPGVPSRFSGSLSGGKATLTISSLQPEDFATYYCALWYSNHWVFGQGTKVELKGGGGSGGGGSGGGGSSGGGSEVQLVESGGGLVQPGGSLRLSCAVSGFSLTDYGVNWVRQAPGKGLEWLGVIWGDGTTDYADSLKGRFTISKDNSKNTVYLQMNSLRAEDTAVYYCVTGLFDYWGQGTLLTVSS

SEQ ID NO: 388 - protein, 243 aa, Artificial Sequence
  Made in Lab - Humanized scFv fragments
EVQLVESGGGLVQPGGSLRLSCAASGFSLTDYGVNWVRQAPGKGLEWVSVIWGDGTTDYADSVKGRFTISRDNSKNTLYLQMNSLRAEDTAVYYCARGLFDYWGQGTLVTVSSGGGGSGGGGSGGGGSSGGGSDIQMTQSPSSLSASVGDRVTITCRSSTGAVTTSNYASWYQQKPGKAPKLLIYGTNNRAPGVPSRFSGSGSGTDFTLTISSLQPEDFATYYCALWYSNHWVFGQGTKVEIK

SEQ ID NO: 389 - protein, 434 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 390 - protein, 437 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPDFWVLVVVGGVLACYSLLVTVAFIIFWVKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 391 - protein, 436 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 392 - protein, 462 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 393 - protein, 478 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSESKYGPPCPPCPDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 394 - protein, 504 aa, Artificial Sequence
  Made in Lab - CAR construct
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 395 - protein, 467 aa, Artificial Sequence
  Made in Lab - CAR construct
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 396 - protein, 509 aa, Artificial Sequence
  Made in Lab - CAR construct
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 397 - protein, 465 aa, Artificial Sequence
  Made in Lab - CAR construct
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 398 - protein, 24 aa, Artificial Sequence
  Made in Lab - CAR construct fragment
IYIWAPLAGTCGVLLLSLVITLYC

SEQ ID NO: 399 - protein, 478 aa, Artificial Sequence; identical to SEQ ID NO: 393
  Made in Lab - CAR construct

SEQ ID NO: 400 - DNA, 1434 bp, Artificial Sequence
  Made in Lab - CAR construct
gacgccgttgtgacccaggaatccgctctgacctcttctccaggcgaaaccgtgactctgacttgccgtagtagcaccggggctgtgaccacatctaactatgccagttgggtccaggaaaaaccggatcacctgtttactggcctgattggcggcaccaacaatcgcgcaccgggtgtgcccgctcgtttcagcggttccctgattggggacaaggcagcactgactatcaccggcgcccagaccgaagatgaggcgatctatttttgcgtcctgtggtacagcgaccattgggtgttcgggggaggcaccaaactgacagtgctgggcggaggaggaggttcaggaggaggaggtagcgggggaggcggttccgggggaggcggttctgatgtgcagctgcaagaatccgggccaggactggttgcgccttctcagagtctgtcaattacatgtactgttagtggctttctgctgaccgactatggtgtgaactgggttcgtcagagcccaggcaagggtctggagtggctgggagtgatttggggggatggaatcacagactacaatagcgcactgaaatctcggctgagtgttaccaaagataacagcaagtcccaggtcttcctgaagatgaacagcctgcaaagcggcgactccgctcgctattactgcgttaccggactgtttgattattgggggcaggggacaactctgactgtttcctccgaaagcaagtatggcccaccttgtccaccttgtcccgatttttgggttctggtagttgtgggaggtgttctcgcctgttatagtctcctcgttactgtagcgttcatcattttttgggtaaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 401 - protein, 478 aa, Artificial Sequence
  Made in Lab - CAR construct
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTAVYYCVTGLFDYWGQGTLLTVSSESKYGPPCPPCPDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 402 - DNA, 1434 bp, Artificial Sequence
  Made in Lab - CAR construct
caggcggtagtcacccaggagccaagtctcacggtgagccccggcggtaccgtcacacttacatgcggaagctctaccggggctgtgaccacaagcaactacgcatcctgggtccagcagaaacccggtcaggcgccccggggcctcattggtgggacaaataacagagccccgggtgttcccgcccgattttctggcagtcttctgggaggaaaggccgctctgacaatatctggcgcacagcccgaagacgaggccgagtactattgcgtgttgtggtatagcgaccactgggtattcggtggaggaacaaagctgacagtgctcggcggaggaggaggttcaggaggaggaggtagcgggggaggcggttccgggggaggcggttctcaagtgcaattgcaggagagtggacctggactcgtgaaaccatctgaaacactctccataacttgtacggtttcagggttcctgctgacagactatggagtaaactgggttaggcagccacccggcaagggcttggagtggctgggcgtcatttggggcgacggaatcaccgactataacccatcactcaaatctcggcttaccgtctccaaggatacgagtaagaatcaggtcagcctgaaaatgtcatccctcacagctgcggacaccgccgtgtactactgtgtgacaggactttttgactactggggccaggggaccctgctcacagttagctccgaaagcaagtatggcccaccttgtccaccttgtcccgatttttgggttctggtagttgtgggaggtgttctcgcctgttatagtctcctcgttactgtagcgttcatcattttttgggtaaggagtaagaggagcaggctcctgcacagtgactacatgaacatgactccacgccgcccaggtcctacacgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 403 - protein, 478 aa, Artificial Sequence
  Made in Lab - CAR construct
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSSESKYGPPCPPCPDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 404 - DNA, 1434 bp, Artificial Sequence
  Made in Lab - CAR construct
caggctgtggtgactcaagagccctcactgactgtgtccccaggagggacagtcactctcacctgtggctccagcactggagctgtcaccacttccaactatgcctcatgggtgcaggagaagcctgaccacctcttcagggggctgattggtggcacaaacaacagggctcctggggtgcctgcccggttctcaggctccctccttgggggcaaagctgccctgaccatttcgggtgcgcagcctgaggatgaggctatttatttctgcgtgctctggtatagtgaccattgggtgttcggcggagggaccaagctgaccgtcctaggcggcggaggaggttcaggaggaggaggtagcggcggaggcggttccgggggaggaggttctcaggtgcaactgcaggagtcgggcccaggactggtgaagccttcggagaccctgtccatcacctgcactgtctctggtttcctgctgaccgactacggcgtaaactgggtgcggcagcccccagggaagggactggagtggctgggggtgatctggggtgacgggatcaccgactacaacccctccctcaagagtcgactgaccgtgtccaaggacacatccaagaaccaggtgtccctgaagatgagctctctgaccgccgcagacacggcccggtattactgtgtcaccggcctgttcgactactggggccagggcaccaccctgaccgtctcctcagaaagcaagtatggcccgccttgtccaccttgtcccgatttttgggttctggtagttgtgggaggtgttctcgcctgttatagtctcctcgttactgtagcgttcatcattttttgggtaaggagtaagaggagcaggctcctgcacagtgactacatgaacatgactccacgccgcccaggtcctacacgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 405 - protein, 478 aa, Artificial Sequence
  Made in Lab - CAR construct
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSSESKYGPPCPPCPDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 406 - DNA, 1434 bp, Artificial Sequence
  Made in Lab - CAR construct
caggctgtggtgactcaggagccctcactgactgtgtccccaggagggacagtcactctcacctgtggctccagcactggagctgtcaccacttccaactatgcctcatgggtgcaggagaagcctgaccacctcttcagggggctgattggtggcacaaacaacagggctcctggggtgcctgcccggttctcaggctccctccttgggggcaaagctgccctgaccatttcgggtgcgcagcctgaggatgaggctatttatttctgcgtgctctggtatagtgaccattgggtgttcggcggagggaccaagctgaccgtcctaggcggtggaggaggtagcggcggtgggggatctggaggcgggggttcaggtggtggtgggtctcaggtgcagctgcaggagtcgggcccaggactggtgaagccttcggagaccctgtccatcacctgcactgtctctggtttcctgctgaccgactacggcgtaaactgggtgcggcagcccccagggaagggactggagtggctgggggtgatctggggtgacgggatcaccgactacaacccctccctcaagagtcgactgaccgtgtccaaggacacatccaagaaccaggtgtccctgaagatgagctctctgaccgacgcagacacggcccggtattactgtgtcaccggcctgttcgactactggggccagggcaccaccctgaccgtctcctcagaaagcaagtatggcccaccttgtccaccttgtcccgatttttgggttctggtagttgtgggaggtgttctcgcctgttatagtctcctcgttactgtagcgttcatcattttttgggtaaggagtaagaggagcaggctcctgcacagtgactacatgaacatgactccacgccgcccaggtcctacacgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 407 - protein, 478 aa, Artificial Sequence
  Made in Lab - CAR construct
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSSESKYGPPCPPCPDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 408 - DNA, 1434 bp, Artificial Sequence
  Made in Lab - CAR construct
caggctgtggtgactcaggagccctcactgactgtgtccccaggagggacagtcactctcacctgtggctccagcactggagctgtcaccacttccaactatgcctcatgggtgcaggagaagcctgaccacctcttcagggggctgattggtggcacaaacaacagggctcctggggtgcctgcccggttctcaggctccctccttgggggcaaagctgccctgaccatttcgggtgcgcagcctgaggatgaggctatttatttctgcgtgctctggtatagtgaccattgggtgttcggcggagggaccaagctgaccgtcctaggcggtggaggaggtagcggcggtgggggatctggaggcgggggttcaggtggtggtgggtctcaggtgcagctgcagcagtcgggcccaggactggtgaagccttcggagaccctgtccatcacctgcactgtctctggtttcctgctgaccgactacggcgtaaactgggtgcggcagcccccagggaagggactggagtggctgggggtgatctggggtgacgggatcaccgactacaacccctccctcaagagtcgactgaccgtgtccaaggacacatccaagaaccaggtgtccctgaagatgagctctctgaccgacgcagacacggcccggtattactgtgtcaccggcctgttcgactactggggccagggcaccaccctgaccgtctcctcagaaagcaagtatggcccaccttgtccaccttgtcccgatttttgggttctggtagttgtgggaggtgttctcgcctgttatagtctcctcgttactgtagcgttcatcattttttgggtaaggagtaagaggagcaggctcctgcacagtgactacatgaacatgactccacgccgcccaggtcctacacgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 409 - protein, 478 aa, Artificial Sequence
  Made in Lab - CAR construct
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSSESKYGPPCPPCPDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 410 - DNA, 1434 bp, Artificial Sequence
  Made in Lab - CAR construct
caggctgtggtgactcaggagccctcactgactgtgtccccaggagggacagtcactctcacctgtggctccagcactggagctgtcaccacttccaactatgcctcatgggtgcaggagaagcctgaccacctcttcagggggctgattggtggcacaaacaacagggctcctggggtgcctgcccggttctcaggctccctccttgggggcaaagctgccctgaccatttcgggtgcgcagcctgaggatgaggctatttatttctgcgtgctctggtatagtgaccattgggtgttcggcggagggaccaagctgaccgtcgacggcggtggaggaggtagcggcggtgggggatctggaggcgggggttcaggtggtggtgggtctcaggtgcagctgcaggagtcgggcccaggactggtgaagccttcggagaccctgtccatcacctgcactgtctctggtttcctgctgaccgactacggcgtaaactgggtgcggcagcccccagggaagggactggagtggctgggggtgatctggggtgacgggatcaccgactacaacccctccctcaagagtcgactgaccgtgtccaaggacacatccaagaaccaggtgtccctgaagatgagctctctgaccgacgcagacacggcccggtattactgtgtcaccggcctgttcgactactggggccagggcaccaccctgaccgtctcctcagaaagcaagtatggcccaccttgtccaccttgtcccgatttttgggttctggtagttgtgggaggtgttctcgcctgttatagtctcctcgttactgtagcgttcatcattttttgggtaaggagtaagaggagcaggctcctgcacagtgactacatgaacatgactccacgccgcccaggtcctacacgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 411 - protein, 478 aa, Artificial Sequence
  Made in Lab - CAR construct
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSSESKYGPPCPPCPDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 412 - DNA, 1434 bp, Artificial Sequence
  Made in Lab - CAR construct
caggctgtggtgactcaggagccctcactgactgtgtccccaggagggacagtcactctcacctgtggctccagcactggagctgtcaccacttccaactatgcctcatgggtgcaggagaagcctgaccacctcttcagggggctgattggtggcacaaacaacagggctcctggggtgcctgcccggttctcaggctccctccttgggggcaaagctgccctgaccatttcgggtgcgcagcctgaggatgaggctatttatttctgcgtgctctggtatagtgaccattgggtgttcggcggagggaccaagctgaccgtcgacggcggaggaggaggttcaggaggcggaggtagcgggggaggcggttccgggggaggcggttctcaggtgcagctgcagcagtcgggcccaggactggtgaagccttcggagaccctgtccatcacctgcactgtctctggtttcctgctgaccgactacggcgtaaactgggtgcggcagcccccagggaagggactggagtggctgggggtgatctggggtgacgggatcaccgactacaacccctccctcaagagtcgactgaccgtgtccaaggacacatccaagaaccaggtgtccctgaagatgagctctctgaccgatgcagacacggcccggtattactgtgtcaccggcctgttcgactactggggccagggcaccaccctgaccgtctcctcagaaagcaagtatggcccaccttgtccaccttgtcccgatttttgggttctggtagttgtgggaggtgttctcgcctgttatagtctcctcgttactgtagcgttcatcattttttgggtaaggagtaagaggagcaggctcctgcacagtgactacatgaacatgactccacgccgcccaggtcctacacgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 413 - protein, 478 aa, Artificial Sequence
  Made in Lab - CAR construct
QAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDGGGGGSGGGGSGGGGSGGGGSQVQLQESGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSSESKYGPPCPPCPDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 414 - DNA, 1434 bp, Artificial Sequence
  Made in Lab - CAR construct
caggctgtggtgactcaggagccctcactgactagctccccaggagggacagtcactctcacctgtggctccagcactggagctgtcaccacttccaactatgcctcatgggtgcaggagaagcctgaccacctcttcagggggctgattggtggcacaaacaacagggctcctggggtgcctgcccggttctcaggctccctccttgggggcaaagctgccctgaccatttcgggtgcgcagcctgaggatgaggctatttatttctgcgtgctctggtatagtgaccattgggtgttcggcggagggaccaagctgaccgtcgacggcggaggaggaggttcaggaggcggaggtagcgggggaggcggttccgggggaggcggttctcaggtgcagctgcaggagtcgggcccaggactggtgaagccttcggagaccctgtccatcacctgcactgtctctggtttcctgctgaccgactacggcgtaaactgggtgcggcagcccccagggaagggactggagtggctgggggtgatctggggtgacgggatcaccgactacaacccctccctcaagagtcgactgaccgtgtccaaggacacatccaagaaccaggtgtccctgaagatgagctctctgaccgatgcagacacggcccggtattactgtgtcaccggcctgttcgactactggggccagggcaccaccctgaccgtctcctcagaaagcaagtatggcccaccttgtccaccttgtcccgatttttgggttctggtagttgtgggaggtgttctcgcctgttatagtctcctcgttactgtagcgttcatcattttttgggtaaggagtaagaggagcaggctcctgcacagtgactacatgaacatgactccacgccgcccaggtcctacacgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 415 - protein, 478 aa, Artificial Sequence
  Made in Lab - CAR construct
QAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVDGGGGGSGGGGSGGGGSGGGGSQVQLQQSGPGLVKPSETLSITCTVSGFLLTDYGVNWVRQPPGKGLEWLGVIWGDGITDYNPSLKSRLTVSKDTSKNQVSLKMSSLTDADTARYYCVTGLFDYWGQGTTLTVSSESKYGPPCPPCPDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 416 - DNA, 1434 bp, Artificial Sequence
  Made in Lab - CAR construct
caggctgtggtgactcaggagccctcactgactagctccccaggagggacagtcactctcacctgtggctccagcactggagctgtcaccacttccaactatgcctcatgggtgcaggagaagcctgaccacctcttcagggggctgattggtggcacaaacaacagggctcctggggtgcctgcccggttctcaggctccctccttgggggcaaagctgccctgaccatttcgggtgcgcagcctgaggatgaggctatttatttctgcgtgctctggtatagtgaccattgggtgttcggcggagggaccaagctgaccgtcgacggcggaggaggaggttcaggaggcggaggtagcgggggaggcggttccgggggaggcggttctcaggtgcagctgcagcagtcgggcccaggactggtgaagccttcggagaccctgtccatcacctgcactgtctctggtttcctgctgaccgactacggcgtaaactgggtgcggcagcccccagggaagggactggagtggctgggggtgatctggggtgacgggatcaccgactacaacccctccctcaagagtcgactgaccgtgtccaaggacacatccaagaaccaggtgtccctgaagatgagctctctgaccgatgcagacacggcccggtattactgtgtcaccggcctgttcgactactggggccagggcaccaccctgaccgtctcctcagaaagcaagtatggcccaccttgtccaccttgtcccgatttttgggttctggtagttgtgggaggtgttctcgcctgttatagtctcctcgttactgtagcgttcatcattttttgggtaaggagtaagaggagcaggctcctgcacagtgactacatgaacatgactccacgccgcccaggtcctacacgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 417 - protein, 27 aa, Artificial Sequence
  Made in Lab - CAR construct fragment
FWVLVVVGGVLACYSLLVTVAFIIFWV

SEQ ID NO: 418 - protein, 41 aa, Artificial Sequence
  Made in Lab - CAR construct fragment
RSKRSRLLHSDYMNMTPRRPGPTRKHYQPYAPPRDFAAYRS

SEQ ID NO: 419 - protein, 42 aa, Artificial Sequence
  Made in Lab - CAR construct fragment
KRGRKKLLYIFKQPFMRPVQTTQEEDGCSCRFPEEEEGGCEL

SEQ ID NO: 420 - protein, 112 aa, Artificial Sequence
  Made in Lab - CAR construct fragment
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 421 - protein, 39 aa, Artificial Sequence
  Made in Lab - CAR construct fragment
IEVMYPPPYLDNEKSNGTIIHVKGKHLCPSPLFPGPSKP

SEQ ID NO: 422 - protein, 13 aa, Artificial Sequence
  Made in Lab - CAR construct fragment
ESKYGPPCPPCPD

SEQ ID NO: 423 - protein, 243 aa, Artificial Sequence
  Made in Lab - Humanized scFv fragments
QVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSSGGGGSGGGGSGGGGSGGGGSQAVVTQEPSLTSSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLG

SEQ ID NO: 424 - protein, 13 aa, Artificial Sequence
  Synthetic Sequence
ESKYGPPCPPCPD

SEQ ID NO: 425 - protein, 14 aa, Artificial Sequence
  Synthetic Sequence
GSSTGAVTTSNYAS

SEQ ID NO: 426 - protein, 7 aa, Artificial Sequence
  Synthetic Sequence
GTNNRAP

SEQ ID NO: 427 - protein, 9 aa, Artificial Sequence
  Synthetic Sequence
VLWYSDHWV

SEQ ID NO: 428 - protein, 10 aa, Artificial Sequence
  Synthetic Sequence
GFLLTDYGVN

SEQ ID NO: 429 - protein, 9 aa, Artificial Sequence
  Synthetic Sequence
VIWGDGITD

SEQ ID NO: 430 - protein, 5 aa, Artificial Sequence
  Synthetic Sequence
GLFDY

SEQ ID NO: 431 - protein, 8 aa, Artificial Sequence
  Synthetic Sequence
DYKDDDDK

SEQ ID NO: 432 - protein, 9 aa, Artificial Sequence
  Synthetic Sequence
DYKDDDDKP

SEQ ID NO: 433 - protein, 28 aa, Artificial Sequence
  Synthetic Sequence
KVAALKEKVAALKEKVAALKEKVAALKE

SEQ ID NO: 434 - protein, 28 aa, Artificial Sequence
  Synthetic Sequence
EVAALEKEVAALEKEVAALEKEVAALEK

SEQ ID NO: 435 - protein, 19 aa, Artificial Sequence
  Synthetic Sequence
NYHLENEVARLKKLGGGGS

SEQ ID NO: 436 - protein, 15 aa, Artificial Sequence
  Synthetic Sequence
YFDYWGQGTLVTVSS

SEQ ID NO: 437 - protein, 12 aa, Artificial Sequence
  Synthetic Sequence
YTFGQGTKLEIK

SEQ ID NO: 438 - protein, 110 aa, Artificial Sequence
  Synthetic Sequence
DAVVTQESALTSSPGETVTLTCRSSTGAVTTSNYASWVQEKPDHLFTGLIGGTNNRAPGVPARFSGSLIGDKAALTITGAQTEDEAIYFCVLWYSDHWVFGGGTKLTVLG

SEQ ID NO: 439 - protein, 98 aa, Artificial Sequence
  Synthetic Sequence
QAVVTQEPSLTVSPGGTVTLTCRSSTGAVTTSNYASWFQQKPGQAPRTLIYGTNNRAPWTPARFSGSLLGGKAALTLSGAQPEDEAEYYCLLSYSGAR

SEQ ID NO: 440 - protein, 12 aa, Artificial Sequence
  Synthetic Sequence
VVFGGGTKLTVL

SEQ ID NO: 441 - protein, 113 aa, Artificial Sequence
  Synthetic Sequence
DVQLQESGPGLVAPSQSLSITCTVSGFLLTDYGVNWVRQSPGKGLEWLGVIWGDGITDYNSALKSRLSVTKDNSKSQVFLKMNSLQSGDSARYYCVTGLFDYWGQGTTLTVSS

SEQ ID NO: 442 - protein, 110 aa, Artificial Sequence
  Synthetic Sequence
QAVVTQEPSLTVSPGGTVTLTCGSSTGAVTTSNYASWVQEKPDHLFRGLIGGTNNRAPGVPARFSGSLLGGKAALTISGAQPEDEAIYFCVLWYSDHWVFGGGTKLTVLG

SEQ ID NO: 443 - protein, 113 aa, Artificial Sequence
  Synthetic Sequence
QVQLQESGPGLVKPSETLSITCTVSGFLLTDYGVNWVRQPPGKGLEWLGVIWGDGITDYNPSLKSRLTVSKDTSKNQVSLKMSSLTAADTARYYCVTGLFDYWGQGTTLTVSS

SEQ ID NO: 444 - protein, 113 aa, Artificial Sequence; identical to SEQ ID NO: 441
  Synthetic Sequence

SEQ ID NO: 445 - protein, 113 aa, Artificial Sequence
  Synthetic Sequence
QVQLQESGPGLVKPSETLSITCTVSGFLLTDYGVNWVRQPPGKGLEWLGVIWGDGITDYNPSLKSRLTVSKDNSKNQVSLKMSSLTAADTAVYYCVTGLFDYWGQGTLLTVSS

SEQ ID NO: 446 - protein, 113 aa, Artificial Sequence
  Synthetic Sequence
QVQLQESGPGLVKPSETLSLTCTVSGFLLTDYGVNWIRQPPGKGLEWIGVIWGDGITDYNPSLKSRVTISKDNSKNQFSLKLSSVTAADTAVYYCVTGLFDYWGQGTLVTVSS

SEQ ID NO: 447 - protein, 98 aa, Artificial Sequence
  Synthetic Sequence
QAVVTQEPSLTVSPGGTVTLTCGSSTGAVTSGHYPYWFQQKPGQAPRTLIYDTSNKHSWTPARFSGSLLGGKAALTLSGAQPEDEAEYYCLLSYSGAR

SEQ ID NO: 448 - protein, 109 aa, Artificial Sequence
  Synthetic Sequence
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 449 - protein, 109 aa, Artificial Sequence
  Synthetic Sequence
QAVVTQEPSLTVSPGGTVTLTCGSSTGAVTTSNYANWVQEKPDHLFRGLIGGTNKRAPGTPARFSGSLLGDKAALTISGAQPEDEAEYYCALWYSNLWVFGGGTKLTVL

SEQ ID NO: 450 - protein, 109 aa, Artificial Sequence
  Synthetic Sequence
DAVVTQESALTSSPGETVTLTCRSSTGAVTTSNYASWVQEKPDHLFTGLIGGTNNRAPGVPARFSGSLIGGKAALTITGAQTEDEAIYFCVLWYSDHWVFGGGTKLTVL

SEQ ID NO: 451 - protein, 109 aa, Artificial Sequence
  Synthetic Sequence
QAVVTQEPSLTVSPGGTVTLTCRSSTGAVTTSNYASWFQQKPGQAPRTLIYGTNNRAPWTPARFSGSLLGGKAALTLSGAQPEDEAEYYCVLWYSDHWVFGGGTKLTVL

SEQ ID NO: 452 - protein, 109 aa, Artificial Sequence
  Synthetic Sequence
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVL

SEQ ID NO: 453 - protein, 109 aa, Artificial Sequence
  Synthetic Sequence
QAVVTQEPSLTVSPGGTVTLTCGSSTGAVTTSNYASWVQQKPGQAFRGLIGGTNNRAPGVPARFSGSLLGGKAALTISGAQPEDEAEYYCVLWYSDHWVFGGGTKLTVL

SEQ ID NO: 454 - protein, 109 aa, Artificial Sequence
  Synthetic Sequence
QAVVTQEPSLTVSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVL

SEQ ID NO: 455 - protein, 5 aa, Artificial Sequence
  Synthetic GNC4 variant
DLPKQ

What is claimed is:

1. A chimeric antigen receptor-effector cell (CAR-EC) expressing a humanized chimeric antigen receptor (CAR), wherein the humanized CAR comprises an extracellular domain, a transmembrane domain, and an intracellular signaling domain; wherein the extracellular domain comprises a humanized anti-GCN4 scFv comprising light chain CDRs 1-3 and heavy chain CDRs 1-3, respectively, set forth as GSSTGAVTTSNYAS (SEQ ID NO: 425), GTNNRAP (SEQ ID NO:426), VLWYSDHWV (SEQ ID NO:427), GFLLTDYGVN (SEQ ID NO:428), VIWGDGITD (SEQ ID NO:429), and GLFDY (SEQ ID NO:430).

2. The CAR-EC of claim 1, which is a T cell.

3. The CAR-EC of claim 1, wherein the scFv comprises the amino acid sequence set forth in SEQ ID NO: 322.

4. The CAR-EC of claim 1, wherein the CAR comprises a sequence selected from SEQ ID NOS: 401, 403, 405, 407, 409, 411, 413, and 415.

5. The CAR-EC of claim 2, wherein the CAR comprises the amino acid sequence set forth in SEQ ID NO: 411.

6. The CAR-EC of claim 1, wherein the extracellular domain comprises a hinge domain, wherein the hinge domain comprises a sequence selected from SEQ ID NOS: 93-103, 165-168, and 424.

7. The CAR-EC of claim 1, wherein the transmembrane domain comprises an amino acid sequence at least 95% identical to the sequence set forth in SEQ ID NO: 417.

8. The CAR-EC of claim 1, wherein the intracellular signaling domain comprises: a CD3-zeta domain and a CD28 domain; a 4-1BB domain; or a CD28 domain and a 4-1BB domain.

9. The CAR-EC of claim 8, wherein the CD28 domain comprises an amino acid sequence at least 95% identical to the sequence set forth in SEQ ID NO: 418.

10. The CAR-EC of claim 8, wherein the 4-1BB domain comprises an amino acid sequence at least 95% identical to the sequence set forth in SEQ ID NO: 419.

11. The CAR-EC of claim 8, wherein the CD3-zeta domain comprises an amino acid sequence at least 95% identical to the sequence set forth in SEQ ID NO: 420.

12. A chimeric antigen receptor-effector cell (CAR-EC) platform, comprising (1) a CAR-EC of claim 1, and (2) a CAR-EC switch; wherein the CAR-EC switch comprises (a) a chimeric antigen receptor-interacting domain (CAR-ID) comprising a GCN4 derivative peptide that interacts with the anti-GCN4 scFv in the chimeric antigen receptor on the CAR-EC, wherein the GCN4 derivative peptide comprises a sequence set forth in any one of SEQ ID NOS: 26, 36, 139-163 and 245; and (b) a humanized targeting antibody or antigen binding portion thereof that comprises a light chain variable region/heavy chain variable region sequence pair selected from (i) SEQ ID NO: 30/SEQ ID NO: 7; (ii) SEQ ID NO: 30/SEQ ID NO: 6; (iii) SEQ ID NO: 34/SEQ ID NO: 6; and (iv) SEQ ID NO: 34/SEQ ID NO: 7.

13. The CAR-EC platform of claim 12, wherein the humanized targeting antibody or antigen binding portion thereof of the CAR-EC switch comprises a light chain variable region/heavy chain variable region sequence pair selected from (i) SEQ ID NO: 30/SEQ ID NO: 7, and the CAR of the CAR-EC comprises the amino acid sequence set forth in SEQ ID NO: 411.

14. A method of treating a subject afflicted with a disease or condition in which CD19+ cells are implicated in pathology, comprising administering to the subject a CAR-EC platform of claim 12.

15. A polynucleotide encoding a chimeric antigen receptor (CAR), wherein the CAR comprises an extracellular domain, a transmembrane domain, and an intracellular signaling domain; wherein the extracellular domain comprises a humanized anti-GCN4 scFv comprising light chain CDRs 1-3 and heavy chain CDRs 1-3 respectively set forth as GSSTGAVTTSNYAS (SEQ ID NO:425), GTNNRAP (SEQ ID NO:426), VLWYSDHWV (SEQ ID NO:427), GFLLTDYGVN (SEQ ID NO:428), VIWGDGITD (SEQ ID NO:429), and GLFDY (SEQ ID NO:430).

16. A vector comprising the polynucleotide of claim 15.

17. A chimeric antigen receptor-effector cell (CAR-EC) switch comprising:
   a. chimeric antigen receptor-interacting domain (CAR-ID) comprising a GCN4 derivative peptide that comprises a sequence set forth in any one of SEQ ID NOS: 26, 36, 139-163 and 245; and
   b. a humanized anti-CD19 targeting antibody or antigen binding portion thereof that comprises (1) a light chain variable region sequence selected from any one of SEQ ID NOS: 16-25, 27-35, 247, 249, 251, 253, 255, 257, 259, 261, 263, 265, and 267; and (2) a heavy chain variable region sequence selected from any one of SEQ ID NOS: 1-15, 248, 250, 252, 254, 256, 258, 260, 262, 264, 266, and 268.

18. The CAR-EC switch of claim 17, wherein the humanized anti-CD19 targeting antibody or antigen binding portion thereof comprises (1) a light chain variable region sequence selected from the group consisting of SEQ ID NOS: 16-25 and 27-35, and (2) a heavy chain variable region sequence selected from the group consisting of SEQ ID NOS: 1-15.

19. The CAR-EC switch of claim 17, wherein the targeting antibody or antigen binding portion thereof is a scFv.

20. The CAR-EC switch of claim 17, wherein the humanized anti-CD19 targeting antibody comprises (1) a light chain variable region sequence set forth in SEQ ID NO: 30, and (2) a heavy chain variable region sequence set forth in SEQ ID NO: 7.

21. The CAR-EC switch of claim 17, wherein the humanized anti-CD19 targeting antibody comprises a light chain variable region/heavy chain variable region sequence pair selected from (i) SEQ ID NO: 30/SEQ ID NO: 7; (ii) SEQ ID NO: 30/SEQ ID NO: 6; (iii) SEQ ID NO: 34/SEQ ID NO: 6; and (iv) SEQ ID NO: 34/SEQ ID NO: 7.

22. The CAR-EC switch of claim 17, wherein the GCN4 peptide is fused to the N terminus of the light chain variable region sequence.

23. A polynucleotide encoding the CAR-EC switch of claim 17.

24. A vector comprising the polynucleotide of claim 23.

* * * * *